United States Patent 11,725,251 (METHYLATION MARKERS AND TARGETED METHYLATION PROBE PANEL) - sequence listing, part 12

SEQ ID NO: 124540 - DNA, 707 bp, Homo sapiens
  misc_feature 1..707: note = chr5:49736592-49737299
  misc_feature 1..707: note = Hyper
  source 1..707: mol_type = genomic DNA
ctgccctgttacctacgcgcccgactcgcggggcgctgttcgttcaagactcgccccaaagagcgcaggaacgcgagccgcagcagtttcagggttcagcttaggtgacacaaacgtagctaatgggaggccgccgccgactctcccacccgcccttaccagcatccccgcgcctctccccgccacccttgcccggcgcgccggcgatgccctctgcccgcggggacccgagcctcgcgcgccctccgccctccctaccctggaccctgtacccatcacacctggggcactgccgtccgccgagcttgggcgcgcggcagcgagaaggcactggaggaggagcagccggggcgtacgcgccctggcctccagcaggccggggagggcgcgcatggcgccagagggtccgcctgggtcctcgtggagactgctccctcagctcgccgccgcgggtgtccagagtccctgcgcacactcgcaggtggcccggcgctcgcagccagtgccgcgggtaggacgctgaagaaaaggcggaatgggaggggcccggccgccttgccccactcccccgagacgctcttaccgcgcccggccctccatcagttatgcagccctcagccggctgctggcgttcccggatgtgcggtggcggtgctacttcccggctgcagcctctccggcctccgccctctcggctctagcaggtc

SEQ ID NO: 124541 - DNA, 30 bp, Homo sapiens; identical to SEQ ID NO: 94038
  misc_feature 1..30: note = chr5:50217968-50217998
  misc_feature 1..30: note = Hypo
  source 1..30: mol_type = genomic DNA

SEQ ID NO: 124542 - DNA, 311 bp, Homo sapiens; identical to SEQ ID NO: 94039
  misc_feature 1..311: note = chr5:50262925-50263236
  misc_feature 1..311: note = Hyper
  source 1..311: mol_type = genomic DNA

SEQ ID NO: 124543 - DNA, 231 bp, Homo sapiens; identical to SEQ ID NO: 94040
  misc_feature 1..231: note = chr5:50263484-50263715
  misc_feature 1..231: note = Hyper
  source 1..231: mol_type = genomic DNA

SEQ ID NO: 124544 - DNA, 1700 bp, Homo sapiens
  misc_feature 1..1700: note = chr5:50264180-50265880
  misc_feature 1..1700: note = Hyper
  source 1..1700: mol_type = genomic DNA
ttgcttatctgtattcgaggggttagtctccatcctaggattgtccctttcaaaaaaaattttttggatgcatctgttttcactttgcactttcaacgggctggagcagacaatagtgtgaaaaacatctgaaaatatgaggcgacagagctgcatgtgtgtttcatttctgcggtgttaggggagaaaataacaaaagaaacacacactacaacacacacgcacgcacgcacacacacacaccggcccaggacctcagcacaaagggcgcgctgacccagcgctaacacacaagacaaattaaagaaaggggcaaatcggaggaggggctaaggcgagggtccaggcatttcgggaaaagatcaaggacaaggagagttaagaaactgaccgtgggccagggaagaccggagagagagaaagtaaagtgtccaggactggaactcacgtccctgaggcaggggacagtaagtttgcttgtaacacagacagttttccttgactgcaggaaacaagaaaaatagtaatcataaaacaagcacaaatcccccaaacatcaggggggtaaaacccccattattagccatcacaaaccaaaacccaaaccgagtcttttctgctgaattgctgcaagatcacaagagaccaagagatccggagtcaggctgtgaacttgggaaagataagttgcccggcgaggttggaggtagactgaggaacgcctttttttgtgaaggacacaaatatttgcagagtttaaagctgcaggaatacaaaagcaggagtgagattatctgattacggatacaggatgtccgagttgttgcctcccaaaaacgactgcgtaaaaaaaaataaataaaaggccagttcgaaaagtgaaattttaatatcagtgaaagcatcggagggactcggattgaacgcggcagctccggaactggacaacagctgcgtggtgcagccaatcccggggcctgtgggaacgagcgaccgatctcaggaccacgcgggcgagagcaaggagcctcccggccacacagccacaggcgctgcggaacccagcccggactctccccggctggagtgtgcgaagggcttcccgcccaggggcccagggtggtcttagtgaaaaagggatggcgctgcagcactgaccacgttgccctggtttctccatttctccttcccaagtctctgcctctgtttccccatgacccggaggacgcgcctacggaagagacgtctggtcgagggggtgccggggagcggaagggggaggggaaggtctcatccctgggacgctgacacccccctccccgcggcactccagctccgaagagcgagcttcggttccgcccgccctccagaccatttgcttattctcactattgttttaatttattgtgcagcctgttgcgccgcgggcccggctgagccatttggggccctctagatgccctgcagggcgcctgtctccggacgaccaccacgcaggagcagcgggggcacgcgcgtgttttcttgtggataactgcctcggacttggcggggccggtccccacctgaagctcacctcaggcagtcgctagaagttccaatccaatcgtgagctttcctctgggagggacaggatccccttcaactcctgaggctgctcctctgggcgaatcccacagtaattgcgcatttctctccct

SEQ ID NO: 124545 - DNA, 36 bp, Homo sapiens; identical to SEQ ID NO: 94045
  misc_feature 1..36: note = chr5:50674152-50674188
  misc_feature 1..36: note = Hyper
  source 1..36: mol_type = genomic DNA

SEQ ID NO: 124546 - DNA, 30 bp, Homo sapiens; identical to SEQ ID NO: 94046
  misc_feature 1..30: note = chr5:50674452-50674482
  misc_feature 1..30: note = Hyper
  source 1..30: mol_type = genomic DNA

SEQ ID NO: 124547 - DNA, 353 bp, Homo sapiens; identical to SEQ ID NO: 94047
  misc_feature 1..353: note = chr5:50674730-50675083
  misc_feature 1..353: note = Hyper
  source 1..353: mol_type = genomic DNA

SEQ ID NO: 124548 - DNA, 70 bp, Homo sapiens; identical to SEQ ID NO: 94049
  misc_feature 1..70: note = chr5:50677690-50677760
  misc_feature 1..70: note = Hyper
  source 1..70: mol_type = genomic DNA

SEQ ID NO: 124549 - DNA, 77 bp, Homo sapiens; identical to SEQ ID NO: 94050
  misc_feature 1..77: note = chr5:50678114-50678191
  misc_feature 1..77: note = Hyper
  source 1..77: mol_type = genomic DNA

SEQ ID NO: 124550 - DNA, 30 bp, Homo sapiens; identical to SEQ ID NO: 94051
  misc_feature 1..30: note = chr5:50678447-50678477
  misc_feature 1..30: note = Hyper
  source 1..30: mol_type = genomic DNA

SEQ ID NO: 124551 - DNA, 30 bp, Homo sapiens; identical to SEQ ID NO: 94052
  misc_feature 1..30: note = chr5:50679546-50679576
  misc_feature 1..30: note = Hyper
  source 1..30: mol_type = genomic DNA

SEQ ID NO: 124552 - DNA, 518 bp, Homo sapiens; identical to SEQ ID NO: 94053
  misc_feature 1..518: note = chr5:50683061-50683579
  misc_feature 1..518: note = Hyper
  source 1..518: mol_type = genomic DNA

SEQ ID NO: 124553 - DNA, 723 bp, Homo sapiens
  misc_feature 1..723: note = chr5:50685360-50686083
  misc_feature 1..723: note = Hyper
  source 1..723: mol_type = genomic DNA
gggcgagcaagtaagcgggcgggcgggcgggcaagcgagcgagcgagcgagcgcgcgaccgcgggcgggccggcaagcgagcctccagcccagcgctcacggcgctccttgccccgcagcggagcccatctccgccaggcagccagccctgcggccccacgtccacaagcagccggagaagaccacccgcgtgcggactgtgctgaacgagaagcagctgcacaccttgcggacctgctacgccgcaaacccgcggccagatgcgctcatgaaggagcaactggtagagatgacgggcctcagtccccgtgtgatccgggtctggtttcaaaacaagcggtgcaaggacaagaagcgaagcatcatgatgaagcaactccagcagcagcagcccaatgacaaaactgtgagtggctctggggccgggcagggaatgcgagggggaaggagacgcagcgtgcgaggtgcgttcctggtacgcaggatcgcacggttttcaatcctgctcctgggcaggagtttggccggggctgcccctcatccttacccccctacccatgccccgggggacaggctacccggcgccggccgccagctgagggcggggaagctgggaggctccgtgcgccgggggagcagcatccaggtcccaacctcgtgggtgggctcatgcccttccacctcgcctgtacctgtgaaccggagaaacgccgtcctcccctc

SEQ ID NO: 124554 - DNA, 746 bp, Homo sapiens
  misc_feature 1..746: note = chr5:50694717-50695463
  misc_feature 1..746: note = Hyper
  source 1..746: mol_type = genomic DNA
ttctacccccaggtgcgttgcccacgtccagcgggcagggcagcgcagcgcctgtctgcactcaggttaggggtgggaagtgctgggaatgggggacccggacactggtctaaccagccccgccactcccgcgggcaagtcagcccttgatcctttaaagcagggacaatcgacgtggtccgagagaggaaaataagggtatttctgggcccttctctttcaggagttgatcaggttggcagatctggagggctaatccaaacaaggcgcttgacttgtgaggtcgcgagtctagacagagctggtggctcggcggctccttatctttccctggaatcagccgaagaggcgctccccggcccactccgctcggctcgcccgggtccggagccaccgctcgacgcagacggcacaacaaacagcacctgaggctttatagctcgctttattgtttaatggagaatgcggcataacattcatttgtcttcttggttccgcgacctggccgctttgcagccacagacgctgggtacgggcgtgcgccagcgcccggccgttatggtccccatgttgagcagcgccgggcgttccgcttcggcatcgcgcgtgtaagcgcgcacggctctgtccgtgcgccctcaggcccctggagaggtacccagctgcagcccctttcttgcttccaaagcccggaggcggaagggtggagggacagtgaaagaaagcttaggcgaggtgtctttgac

SEQ ID NO: 124555 - DNA, 30 bp, Homo sapiens; identical to SEQ ID NO: 94064
  misc_feature 1..30: note = chr5:51759873-51759903
  misc_feature 1..30: note = Hypo
  source 1..30: mol_type = genomic DNA

SEQ ID NO: 124556 - DNA, 292 bp, Homo sapiens; identical to SEQ ID NO: 94066
  misc_feature 1..292: note = chr5:52285516-52285808
  misc_feature 1..292: note = Hyper
  source 1..292: mol_type = genomic DNA

SEQ ID NO: 124557 - DNA, 30 bp, Homo sapiens; identical to SEQ ID NO: 94069
  misc_feature 1..30: note = chr5:52775107-52775137
  misc_feature 1..30: note = Hyper
  source 1..30: mol_type = genomic DNA

SEQ ID NO: 124558 - DNA, 531 bp, Homo sapiens; identical to SEQ ID NO: 94070
  misc_feature 1..531: note = chr5:52775392-52775923
  misc_feature 1..531: note = Hyper
  source 1..531: mol_type = genomic DNA

SEQ ID NO: 124559 - DNA, 390 bp, Homo sapiens; identical to SEQ ID NO: 94071
  misc_feature 1..390: note = chr5:52776428-52776818
  misc_feature 1..390: note = Hyper
  source 1..390: mol_type = genomic DNA

SEQ ID NO: 124560 - DNA, 139 bp, Homo sapiens; identical to SEQ ID NO: 94072
  misc_feature 1..139: note = chr5:52778602-52778741
  misc_feature 1..139: note = Hyper
  source 1..139: mol_type = genomic DNA

SEQ ID NO: 124561 - DNA, 41 bp, Homo sapiens; identical to SEQ ID NO: 94073
  misc_feature 1..41: note = chr5:52888050-52888091
  misc_feature 1..41: note = Hypo
  source 1..41: mol_type = genomic DNA

SEQ ID NO: 124562 - DNA, 23 bp, Homo sapiens
  misc_feature 1..23: note = chr5:53300030-53300053
  misc_feature 1..23: note = Hypo
  source 1..23: mol_type = genomic DNA
ttaaatattctcggccgggtgtg

SEQ ID NO: 124563 - DNA, 30 bp, Homo sapiens; identical to SEQ ID NO: 94080
  misc_feature 1..30: note = chr5:53674661-53674691
  misc_feature 1..30: note = Hypo
  source 1..30: mol_type = genomic DNA

SEQ ID NO: 124564 - DNA, 35 bp, Homo sapiens
  misc_feature 1..35: note = chr5:53814382-53814417
  misc_feature 1..35: note = Hyper
  source 1..35: mol_type = genomic DNA
ctgtccctgggttcccgcggcggctcggtcccccc

SEQ ID NO: 124565 - DNA, 30 bp, Homo sapiens; identical to SEQ ID NO: 94085
  misc_feature 1..30: note = chr5:54042403-54042433
  misc_feature 1..30: note = Hypo
  source 1..30: mol_type = genomic DNA

SEQ ID NO: 124566 - DNA, 591 bp, Homo sapiens
  misc_feature 1..591: note = chr5:54179554-54180145
  misc_feature 1..591: note = Hyper
  source 1..591: mol_type = genomic DNA
cctccgggaaggccacgcggaggtgaggaacaggtcctgccctggaggcgccagccgcaccgaccgggagatggaagtttttcgcggcggcgccccagccacttcgcagggccgagcggtctcctccaccggccgcccggctcaggaatgccctgcctgcgagtcaaagtcggggtcgcggcggggcgaacctggcccagcattgcctggggccctcaggagcgccgagggggtctccctgccagcgccctcctccccgctcgcccaccctctccaagcgggctccgcgcggccggggatgggacgaggaggggaagtttggggcgcgtacctcctagcgccccgcagaaccccaggcaggcagccagtaggacgaggcggcgggccccgaaccgccccatcccgccgcggcggccccgcgtcccgcgctcactccccagcggcggccgagctacctgcgccgccgcgacccggagcccggcaagggggcgccgccccccaacatctcgggggcagggccggggcggggagagccatttgcatcctgaagctgttgcgccccttcagcgcaaggagcgggctgggccttta

SEQ ID NO: 124567 - DNA, 336 bp, Homo sapiens; identical to SEQ ID NO: 94089
  misc_feature 1..336: note = chr5:54472206-54472542
  misc_feature 1..336: note = Hyper
  source 1..336: mol_type = genomic DNA

SEQ ID NO: 124568 - DNA, 840 bp, Homo sapiens
  misc_feature 1..840: note = chr5:54516334-54517174
  misc_feature 1..840: note = Hyper
  source 1..840: mol_type = genomic DNA
gtggctcaggttcaacgcgctccggctgcagtctgtgcgcagcccccggaaggcgccatgcaggttcccgggcctggtgtcagtattcgcgggctctggcagcagtcggggccgcttgggatcgcggctctgaagggcttcatcgcagcgctcggaaatctccctcaggatggcgtccacttccgcgcaatcctgccccgcagcgctgaccaactcctccaggctccttttggccttcgccttgagcaggaagggctcggccgccgccccacaatcccgggactgtgtgatcatcagcttctacgaaagacagggaagagcgccgccctggggcctgccggaccctccgggttcggagcgtgcaaaaggtgacctaggcgcgctacgcaccacgcactcagcggtactctcctctcccgggcccccacgggtcccgatgctgggcggggatgcactgaactgttcagttccgacgtgctgcagttcccacacgcccgcgccccacttacatccagcaccgaggccaggtgccgggttcggctggcgagttccttcagctgcacgttccgctccttgagcgaggcgatctcctcctgtttctgggtcaatgtcacgtgcagctgcaggaggagacccaaacattcaggggtaggtactgtgctgggtctcgtctgcatatctggcatgaatcaaacccagatcctgacgtctcatcaggaactggggacgcacaggcatttacgctagtgagaataataatcaatttactttttttttaaaacaaagcacttggacaaaatttatctccattaatcctcggtgtagcgtgctgataaagag

SEQ ID NO: 124569 - DNA, 990 bp, Homo sapiens
  misc_feature 1..990: note = chr5:54518651-54519641
  misc_feature 1..990: note = Hyper
  source 1..990: mol_type = genomic DNA
gagttgctggagagtcgttgacagttggctgggtttaccaccttcacgaccacgaaatctgaactagtctgatttgggagtgggggacacccccgctgttatttaactgccaggagactgcacttgcctgaaatgagatcatccaccgtgtctctgaaatcttgcagattgaagtctgcttccgtttggtgggaatggttctgaaaaaaaccagaggtgtacactggttaacgagtctggcgttagaaagccttcaataaatattggcgtccctgttaaaaatctggcaggcactatgcaatatatgcacgtaacacaactgcacttgtacccctaagtccccccaaataaaacaatttttgtggcgggtccggaaccctttctagaccaacagacctcctcccgggctcggcggcggtctgctcgcacttacgtcgccagcccagtctcgtacccgaaaattcaagccccatccgagacagggaacccagcaggcttgcactgccacggtggggagcgggacgcacggagcacgacactgactgggggaagggggcagcagttcgcggctcctgcagagcagctgcgtggcgggaatgggtccttccaccggcggtgcggcggccctgcgccggctccgggcagccgagtagcccgccacccaccaactagctaagcagccgcctctgtgaagctcggcggttccctgtgcgcctgcgaaattttgactccgactcaccagcgaccggccaccgagccgccgctgtaggagctgagagcacgtcttgaacaccggatctttccacccaagacccgacagcgtgcaggggcctcgagcagtaatttgaggccgcgtttcccgccaaggtttggccccagctaaccgccccacccatgcaaccgagcgggaagaaagctgtgattcgaggggccaggagaatacgggaaaagcttctgttctgcgcacagccagtgcggcctccattgctc

SEQ ID NO: 124570 - DNA, 216 bp, Homo sapiens; identical to SEQ ID NO: 94094
  misc_feature 1..216: note = chr5:54523786-54524002
  misc_feature 1..216: note = Hyper
  source 1..216: mol_type = genomic DNA

SEQ ID NO: 124571 - DNA, 501 bp, Homo sapiens
  misc_feature 1..501: note = chr5:54527304-54527805
  misc_feature 1..501: note = Hyper
  source 1..501: mol_type = genomic DNA
catacagtcctccagcgccgcctccgggtggtctcccagtcgcaagtccacgggccgcgagacccgcagcatgcggtccgccagcgccaggcagcagatcgccaggagggaaggggagtagctggtgaaggcatagtcggccagactcagctctgccaccccccgcgccagggcttgcgcttccagagcttcggaggcctcagcctgccccgcctccacgcgagcgtgcgtgaaatgctccaggaagaagctaatggtgggcgcacccagggtgaagtgcagcttgtgcagcacgatgcactcgaggttgcagagctgctgccgggagaaggcgccgcagcagagggccagaagctgcttcacgcgcggcgggtgcacctccacctgcaacacagggcgcactcaaccccgctttgcggcttcccgggccccaggcccaccccagtatgacgcccggactttccccatcccttccagagagacagccggggctctgcctct

SEQ ID NO: 124572 - DNA, 41 bp, Homo sapiens; identical to SEQ ID NO: 94096
  misc_feature 1..41: note = chr5:54528342-54528383
  misc_feature 1..41: note = Hyper
  source 1..41: mol_type = genomic DNA

SEQ ID NO: 124573 - DNA, 46 bp, Homo sapiens; identical to SEQ ID NO: 94097
  misc_feature 1..46: note = chr5:55309312-55309358
  misc_feature 1..46: note = Hypo
  source 1..46: mol_type = genomic DNA

SEQ ID NO: 124574 - DNA, 167 bp, Homo sapiens; identical to SEQ ID NO: 94105
  misc_feature 1..167: note = chr5:55776589-55776756
  misc_feature 1..167: note = Hyper
  source 1..167: mol_type = genomic DNA

SEQ ID NO: 124575 - DNA, 30 bp, Homo sapiens; identical to SEQ ID NO: 94106
  misc_feature 1..30: note = chr5:55777140-55777170
  misc_feature 1..30: note = Hyper
  source 1..30: mol_type = genomic DNA

SEQ ID NO: 124576 - DNA, 39 bp, Homo sapiens
  misc_feature 1..39: note = chr5:56248218-56248257
  misc_feature 1..39: note = Hyper
  source 1..39: mol_type = genomic DNA
aggcaagtgggggacggacggacgcgcgggcgcgggaca

SEQ ID NO: 124577 - DNA, 39 bp, Homo sapiens; identical to SEQ ID NO: 94108
  misc_feature 1..39: note = chr5:56346672-56346711
  misc_feature 1..39: note = Hypo
  source 1..39: mol_type = genomic DNA

SEQ ID NO: 124578 - DNA, 876 bp, Homo sapiens; identical to SEQ ID NO: 94111
  misc_feature 1..876: note = chr5:57877797-57878673
  misc_feature 1..876: note = Hyper
  source 1..876: mol_type = genomic DNA

SEQ ID NO: 124579 - DNA, 280 bp, Homo sapiens
  misc_feature 1..280: note = chr5:57878910-57879190
  misc_feature 1..280: note = Hyper
  source 1..280: mol_type = genomic DNA
gttggagccggttagcgaaccccaagagtgcagagtgtggagcgtggagcgccgggactgtgcacgcttgaccggaagcccagaccagtgcggtcctagccagagagaaaggacatttgccaacaatgagacacgaagcgcccatgcaggtgggtccataaagaaagagtggcctcgggaggaattgaaagagatgcttttccccttgctccgcgcacaagcagttcaacgtaaggaaaggtctaggcggtcacccgcggagatgcggctctgtgacatg

SEQ ID NO: 124580 - DNA, 339 bp, Homo sapiens; identical to SEQ ID NO: 94115
  misc_feature 1..339: note = chr5:58335014-58335353
  misc_feature 1..339: note = Hyper
  source 1..339: mol_type = genomic DNA

SEQ ID NO: 124581 - DNA, 318 bp, Homo sapiens; identical to SEQ ID NO: 94116
  misc_feature 1..318: note = chr5:58335563-58335881
  misc_feature 1..318: note = Hyper
  source 1..318: mol_type = genomic DNA

SEQ ID NO: 124582 - DNA, 50 bp, Homo sapiens; identical to SEQ ID NO: 94122
  misc_feature 1..50: note = chr5:59064594-59064644
  misc_feature 1..50: note = Hyper
  source 1..50: mol_type = genomic DNA

SEQ ID NO: 124583 - DNA, 72 bp, Homo sapiens; identical to SEQ ID NO: 94124
  misc_feature 1..72: note = chr5:59188376-59188448
  misc_feature 1..72: note = Hyper
  source 1..72: mol_type = genomic DNA

SEQ ID NO: 124584 - DNA, 603 bp, Homo sapiens
  misc_feature 1..603: note = chr5:59188904-59189507
  misc_feature 1..603: note = Hyper
  source 1..603: mol_type = genomic DNA
ttggtggtgataagccgacttagatggagtatttgagaaaaggggaggtgaccctttgcctgaatgggggagggggcgctctccactcaccgcctgagtccctggaacgaggagggccaggacatcctggatttcttcaggccgggccggtggccggtctccaccgcgtaggaggtgcggtccatggcgcgacagtacaggtagcgctcggtgtccgagtagccgcgatgccggacgcggccggtggccccgctcgaggcgtagcggccgcgggcagccccgggcggcggcgggggcggcggcagggggggcggcggcggcggctgtagcggacactggggctggggctggggcgagggtggcggcggcgggggcaggtggtgatggggatgcaggaggcggaactggggctgccggagcgggtactggtggtgctgctcgtgcctccagagatgcttgggggctttgagcgtggccccgccggcgctgtcgctgccctctccgctgcccgcccgggccggcgcgctgctgccctctgcctccatcctggctcgcggctccgcgacctgctgcccagcccgggttcaccgcgctggcccgagc

SEQ ID NO: 124585 - DNA, 375 bp, Homo sapiens; identical to SEQ ID NO: 94127
  misc_feature 1..375: note = chr5:59189708-59190083
  misc_feature 1..375: note = Hyper
  source 1..375: mol_type = genomic DNA

SEQ ID NO: 124586 - DNA, 30 bp, Homo sapiens; identical to SEQ ID NO: 94130
  misc_feature 1..30: note = chr5:60139344-60139374
  misc_feature 1..30: note = Hyper
  source 1..30: mol_type = genomic DNA

SEQ ID NO: 124587 - DNA, 30 bp, Homo sapiens; identical to SEQ ID NO: 94131
  misc_feature 1..30: note = chr5:60182155-60182185
  misc_feature 1..30: note = Hypo
  source 1..30: mol_type = genomic DNA

SEQ ID NO: 124588 - DNA, 37 bp, Homo sapiens; identical to SEQ ID NO: 94135
  misc_feature 1..37: note = chr5:62077372-62077409
  misc_feature 1..37: note = Hypo
  source 1..37: mol_type = genomic DNA

SEQ ID NO: 124589 - DNA, 397 bp, Homo sapiens
  misc_feature 1..397: note = chr5:63254903-63255300
  misc_feature 1..397: note = Hyper
  source 1..397: mol_type = genomic DNA
gcgagtgttgggacacgctaaacagaattattccccgatccaaaaaggacaagagcgtgaattaggaggaaaaattctacatcgtaaggataaaattgctctttcaggttttactgggggagccagctggagccttgggcacgcgcgccctggggaacctttcctctttgccgcccctgcgtgtcgcccctttaaagccttcttggtctctccaatcccaagagttccgcggcatcttgcgccactggctaaggcaaaaacctcaggtgtctacccgcgcttcagggcgccccagagcgtaggcggaggaacccagatcctgtaagtcagcagccgggagcgcctagcgcgctgcgagagcacagatggctggggaggcgcgcggattccaggcctc

SEQ ID NO: 124590 - DNA, 69 bp, Homo sapiens; identical to SEQ ID NO: 94140
  misc_feature 1..69: note = chr5:63257323-63257392
  misc_feature 1..69: note = Hyper
  source 1..69: mol_type = genomic DNA

SEQ ID NO: 124591 - DNA, 250 bp, Homo sapiens; identical to SEQ ID NO: 94141
  misc_feature 1..250: note = chr5:63257611-63257861
  misc_feature 1..250: note = Hyper
  source 1..250: mol_type = genomic DNA

SEQ ID NO: 124592 - DNA, 40 bp, Homo sapiens; identical to SEQ ID NO: 94142
  misc_feature 1..40: note = chr5:63373761-63373801
  misc_feature 1..40: note = Hypo
  source 1..40: mol_type = genomic DNA

SEQ ID NO: 124593 - DNA, 764 bp, Homo sapiens; identical to SEQ ID NO: 94143
  misc_feature 1..764: note = chr5:63461355-63462119
  misc_feature 1..764: note = Hyper
  source 1..764: mol_type = genomic DNA

SEQ ID NO: 124594 - DNA, 820 bp, Homo sapiens
  misc_feature 1..820: note = chr5:63801787-63802607
  misc_feature 1..820: note = Hyper
  source 1..820: mol_type = genomic DNA
atcaatgtgcgggcccgcgaacaacgtcagccggaccgattctctgcgtctgccagtcccgccacagattcatctgggatcttcaaacagacaagcccttagagacgagggatcaaggcagccgattagagccaattgcttgctttggggacggccagtccttccaggcctggcgacagtggagggaggggaaagacgaaccgagtgccgctgcgggaagacactgaagcaagagcgacacccctttccgccccccaccttgcagcgcaggctttgaaagctgctcccccacctgaatggaaactcggaaccgccgggcggcgcgttccttctcgcccagccttgcaatccatgccgagaggaaggcagtgcgagcccgcgccagcgcccagctcccgggacagggtcggcaatgctgctgagcagaacttgatcgcgctccttcctcgctgctagtggaagcgatgctgcacggcacagctagcgcttccccggctctccttcaagctgaaggttaccgacccgcgcagccagccccagcactgtgagctgcgcgcctcaggtccgggctccggctgcttggcggcggcgcccagggcaacaaccgggccgcccgcgccggggcgcactgcaccagcggcttcggcttggtggatgtgtatgcatgagttctgcaccgaatgggcgcaaaaagcgccccagccggtccacccgctcctcgatcttccagatcagcaagcccccgctgcagagcggagattgggagcgcaggggcagcggctccgagagcgcccacaaaacccaacgagccctggacgac

SEQ ID NO: 124595 - DNA, 810 bp, Homo sapiens
  misc_feature 1..810: note = chr5:63986174-63986984
  misc_feature 1..810: note = Hyper
  source 1..810: mol_type = genomic DNA
aaagtggaggagagtcggcgccgagatgggcggataaaaggagcgaccgctcagcagcgagagggagaggcgagagtaaggcgcccagacaccatgtggacaaggggaggagagaaatcagaggtggcgcgcgaaggctgagcgcccaggcagccagagcccagatcggaagagccgagtccgggcagaggggtccgcgggctctggaggtgctggacgggtgcgatccgagagcagaccggggccctcgcgagcctctcccggcccctgcccgcgatgagcgaggccagccgactgtgctccggctactacagcctcaaccagagcttcgtggagcccttccagtgcccccggcgcggcgagggggcagcgctccagtattgctgcggcttcgccgacctcaagtactgctgcagcgagccgggcagctacttcccctacaagcacagctacatgtggagcctcaggtgggctgagagcccgcgcgtgcggcggctggccgagcccggggctagggaggcgacaagcggagccacgccagggccagggaggttcccccgcgtccccgctatccgccctaggttaggtccctacggaaggacgcggagcctctgagggcgggtgagggcagggagagaaatctcgccccggctcggagctcccccgggagccaggacaggaggcgaggcgcacgctggaggagcgcgggctttgcgcccagggcgcacttggggcccgcctggctggccccgctgagttccccgcccgcctcccgggagccgactgctctcccctcgccgggaccagtcc

SEQ ID NO: 124596 - DNA, 30 bp, Homo sapiens; identical to SEQ ID NO: 94152
  misc_feature 1..30: note = chr5:64767606-64767636
  misc_feature 1..30: note = Hypo
  source 1..30: mol_type = genomic DNA

SEQ ID NO: 124597 - DNA, 153 bp, Homo sapiens; identical to SEQ ID NO: 94154
  misc_feature 1..153: note = chr5:64860458-64860611
  misc_feature 1..153: note = Hypo
  source 1..153: mol_type = genomic DNA

SEQ ID NO: 124598 - DNA, 32 bp, Homo sapiens; identical to SEQ ID NO: 40549
  misc_feature 1..32: note = chr5:65181746-65181778
  misc_feature 1..32: note = Hypo
  source 1..32: mol_type = genomic DNA

SEQ ID NO: 124599 - DNA, 60 bp, Homo sapiens; identical to SEQ ID NO: 94156
  misc_feature 1..60: note = chr5:65220787-65220847
  misc_feature 1..60: note = Hyper
  source 1..60: mol_type = genomic DNA

SEQ ID NO: 124600 - DNA, 30 bp, Homo sapiens; identical to SEQ ID NO: 29628
  misc_feature 1..30: note = chr5:65891802-65891832
  misc_feature 1..30: note = Hyper
  source 1..30: mol_type = genomic DNA

SEQ ID NO: 124601 - DNA, 71 bp, Homo sapiens; identical to SEQ ID NO: 94163
  misc_feature 1..71: note = chr5:65893398-65893469
  misc_feature 1..71: note = Hyper
  source 1..71: mol_type = genomic DNA

SEQ ID NO: 124602 - DNA, 67 bp, Homo sapiens; identical to SEQ ID NO: 94164
  misc_feature 1..67: note = chr5:66511784-66511851
  misc_feature 1..67: note = Hyper
  source 1..67: mol_type = genomic DNA

SEQ ID NO: 124603 - DNA, 30 bp, Homo sapiens; identical to SEQ ID NO: 94165
  misc_feature 1..30: note = chr5:66673601-66673631
  misc_feature 1..30: note = Hypo
  source 1..30: mol_type = genomic DNA

SEQ ID NO: 124604 - DNA, 145 bp, Homo sapiens; identical to SEQ ID NO: 94168
  misc_feature 1..145: note = chr5:67573236-67573381
  misc_feature 1..145: note = Hypo
  source 1..145: mol_type = genomic DNA

SEQ ID NO: 124605 - DNA, 496 bp, Homo sapiens; identical to SEQ ID NO: 94169
  misc_feature 1..496: note = chr5:67583945-67584441
  misc_feature 1..496: note = Hyper
  source 1..496: mol_type = genomic DNA

SEQ ID NO: 124606 - DNA, 30 bp, Homo sapiens; identical to SEQ ID NO: 94170
  misc_feature 1..30: note = chr5:67591271-67591301
  misc_feature 1..30: note = Hypo
  source 1..30: mol_type = genomic DNA

SEQ ID NO: 124607 - DNA, 226 bp, Homo sapiens; identical to SEQ ID NO: 40551
  misc_feature 1..226: note = chr5:67840329-67840555
  misc_feature 1..226: note = Hypo
  source 1..226: mol_type = genomic DNA

SEQ ID NO: 124608 - DNA, 49 bp, Homo sapiens; identical to SEQ ID NO: 94174
  misc_feature 1..49: note = chr5:68370981-68371030
  misc_feature 1..49: note = Hypo
  source 1..49: mol_type = genomic DNA

SEQ ID NO: 124609 - DNA, 17 bp, Homo sapiens
  misc_feature 1..17: note = chr5:68391002-68391019
  misc_feature 1..17: note = Hypo
  source 1..17: mol_type = genomic DNA
gtaatagcattataacg

SEQ ID NO: 124610 - DNA, 17 bp, Homo sapiens
  misc_feature 1..17: note = chr5:68391319-68391336
  misc_feature 1..17: note = Hypo
  source 1..17: mol_type = genomic DNA
cccgcccaacataagca

SEQ ID NO: 124611 - DNA, 78 bp, Homo sapiens; identical to SEQ ID NO: 94178
  misc_feature 1..78: note = chr5:68475607-68475685
  misc_feature 1..78: note = Hypo
  source 1..78: mol_type = genomic DNA

SEQ ID NO: 124612 - DNA, 1208 bp, Homo sapiens
  misc_feature 1..1208: note = chr5:71014657-71015865
  misc_feature 1..1208: note = Hyper
  source 1..1208: mol_type = genomic DNA
cttggggttggggtgcgaggcaaggcagggctggcgaggtggatgttgcagctgtcaccactgctaggtgttgggaaacgactctcctgcctgtgcattgacccgaaggcattttccatttcctaggcccctcccgcttcccgtccctcacctctagcccctcggcttcagctcaggcccctcggggagcatcccttgccgtgagactgacagcctttgggggcgcagggtcctgttctctgcgctctagcccatctgtgcgcagagcctcgttcccaggcgcctggaacccggcgggcattgacgtcaagcgccggcggagcgctgcctacagacggttgacccgggccctcctccacacccccttccttcttcgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctggtcggtattcccctcgctctcgacccccttgagctgtcgccttgtctcttctcttgcacgcctccctcctccccccacccccactcctattcccagagtcagggcgcggggagctgagcgcaacgcccaggcacccactgccatccgaagagcgtctcgagctcacgggctcctggcagtctgttgagcgaatccctcatcccggcccctctgagcaacagggaccccagcggctcagagacccgcggtcagtacctgggacagcgtccgctaagtttccacccctcgaccattccctgtgtccgcggagtcccaccgcagagtgcgtgtgggtccggggctccttataactagggctggaagtgcgcacctgggctgggctcgcagccaaggcggcaacttcaggctccgaagcggtgtgttgcagatcgaagcgctgcaagaagtcttgaagaagctcaagagtaaacgtgttcccatctatgagaagaagtatggccaagtccccatggtaaggtttgtggtcactcccttcccgtgtttttccaagagaaagtacaccgccttgaatcgtacacacagtctt

SEQ ID NO: 124613 - DNA, 1211 bp, Homo sapiens; identical to SEQ ID NO: 94184
  misc_feature 1..1211: note = chr5:71402862-71404073
  misc_feature 1..1211: note = Hyper
  source 1..1211: mol_type = genomic DNA

SEQ ID NO: 124614 - DNA, 489 bp, Homo sapiens
  misc_feature 1..489: note = chr5:71404392-71404881
  misc_feature 1..489: note = Hyper
  source 1..489: mol_type = genomic DNA
gccggggaccctgggcggggccgtgagggtccggcgggcacagcctcgggcgcacagagagaccgcccccagccccacccgagctgccgcagtgcctccggaccgcccgccacacctgcccccccacactgcggcgcccccgtcgggcacggctggctgggcttgcgctccgcccgggcctcgggctggcgggggccgcgcgcccccacctctcagtttgcctggctttgttgccctgggagtccctgggtgggcagctctggtctctgcctttccctttatccctggcgtcccggccctcccctcgctcctgacagaggtcgccgggtccctccgcagccccagcccgcgctctattctcctggggtggtgctgaagcgtttctccgggagacaccggttggtgggcgtggtgcagtccgcactgcggtctctacggcagcccgaggcggacaaagggcgttcacgcagccctcgttccccactcccc

SEQ ID NO: 124615 - DNA, 156 bp, Homo sapiens; identical to SEQ ID NO: 94187
  misc_feature 1..156: note = chr5:71491785-71491941
  misc_feature 1..156: note = Hypo
  source 1..156: mol_type = genomic DNA

SEQ ID NO: 124616 - DNA, 30 bp, Homo sapiens; identical to SEQ ID NO: 40555
  misc_feature 1..30: note = chr5:72175493-72175523
  misc_feature 1..30: note = Hypo
  source 1..30: mol_type = genomic DNA

SEQ ID NO: 124617 - DNA, 240 bp, Homo sapiens; identical to SEQ ID NO: 94189
  misc_feature 1..240: note = chr5:72236789-72237029
  misc_feature 1..240: note = Hypo
  source 1..240: mol_type = genomic DNA

SEQ ID NO: 124618 - DNA, 406 bp, Homo sapiens
  misc_feature 1..406: note = chr5:72415759-72416165
  misc_feature 1..406: note = Hyper
  source 1..406: mol_type = genomic DNA
gagcgcacgtcgtcccgtgacctggtggctccatattcgatggggagctcgcagcgagtcgcttccctctgtaaccccactccaggtctccagagcagtaggagggccacagggctgctgggtgtagtcgccccggacctcgcggtggccaaggccaaggcggccggggcacggtaccctgttcggcctgggccgcaaccacgaaggaggcggtggaggcgggggccggcgcttcctccgcgccccccacgccgccgctctctcgcgcccctatagaactgggcctcaggcctcgagggggagcgggcctcggcgggcggggcgcacagttccgccagccggcgggggcatctcaactcgccggccccgccaggtgtgcgggccaggcagccgtggaaggtgccca

SEQ ID NO: 124619 - DNA, 294 bp, Homo sapiens; identical to SEQ ID NO: 94192
  misc_feature 1..294: note = chr5:72497893-72498187
  misc_feature 1..294: note = Hyper
  source 1..294: mol_type = genomic DNA

SEQ ID NO: 124620 - DNA, 30 bp, Homo sapiens; identical to SEQ ID NO: 94193
  misc_feature 1..30: note = chr5:72511476-72511506
  misc_feature 1..30: note = Hyper
  source 1..30: mol_type = genomic DNA

SEQ ID NO: 124621 - DNA, 191 bp, Homo sapiens; identical to SEQ ID NO: 94194
  misc_feature 1..191: note = chr5:72512184-72512375
  misc_feature 1..191: note = Hyper
  source 1..191: mol_type = genomic DNA

SEQ ID NO: 124622 - DNA, 663 bp, Homo sapiens
  misc_feature 1..663: note = chr5:72526037-72526700
  misc_feature 1..663: note = Hyper
  source 1..663: mol_type = genomic DNA
gctactgctagccctcgccccagactgtccggttctcaggagggtttgcgcggcctgtttgccaagcctgggtaggcgggacagggggattcccaaggccgatcagattctatttactgccctcttccccaaccccggggccacctctgaggcatgaacccagagacgcgcgccctggtctgggaaagcaggaccgctgcgcccagcgcctcaggggtagaggcgggaacaggcccgcggtcgctttgctggcggggaagggcgatctgacgatcagggagttgcgcccctctctctgggcctcgtgaaggaacagagcaattacagcgctgggccggccacgtagtcctggggctaggtgggcccaatgctccgggccgcggggctggagcgcggaggctggagagggaggaggaccctccgcggctccaggcctcccagctggaggggctcacgcccgggactccccatcagacctttgagggggagcttctcaaaaagccctaaactcctcgaggatattctccgagtgcttctccttacccaagcgctgcttccagactccacgcctctagaactagctggcgtccacggtcggccagagcagttagggggctgcgctagcagggacatgtggggcaaaagagacgtattttaaaaccc

SEQ ID NO: 124623 - DNA, 552 bp, Homo sapiens
  misc_feature 1..552: note = chr5:72528095-72528647
  misc_feature 1..552: note = Hyper
  source 1..552: mol_type = genomic DNA
atagactcagaaacccgggagagtttaggagaccgccgaggcgagcactttctctaacaatcgcgtgctgcagtcaggagagcccaggtggctgcggccgcccttaggagaccagtgatcatcccagccacctccctgcccagccccgggccgaactggaaaactcttaactttgggctttatttaaaacactcgggtttcgaaagccgggtcccctccgcaggccaggaggcctcagtgagcatcctgtgctgcgtggggagggcctggcagctggcggatccgtctgggctgcagctgcagggtcgggagctcttcttggactcggctcctttcagaaaactcttttcttgtcggatgtggtttccctttaattaatcactcatgcccgcgtgtccaccgcgccgcttccccactcttcctccagccccgcatgtgatctctatttggaggcaggagagctggtggagcatctggggttgccgcggaggtggttctgcctgccgctgggcttcgggccgccgcccagagacagagcgatatcctcccaga

SEQ ID NO: 124624 - DNA, 1643 bp, Homo sapiens
  misc_feature 1..1643: note = chr5:72528993-72530636
  misc_feature 1..1643: note = Hyper
  source 1..1643: mol_type = genomic DNA
gtgcaggctcctttccggaaagccctggccccaaaccccaacatcaagccactctcaggattgcggggcagtgggcaagacctgatccagagggtgtgcattaagccgttgccctcgttgcgtttaattctcccgtcactccccagtcactaagggaggcctcctactcgcgcctcagcttcaagggcggatgtggctgggaccaccctgggactcgggtgtctccaaatgtggctcaggccgccccacgccgaacgaggtgggatcagatattcccgcttgtgagtgttggtggggctgaagagatcacacgcggcggggtgtggaacttcgaggggtgtcacggccagggctttgcggccccagacgtcccagcggctcgcagggggcgccaggtccgcgcttccccttgggtcttcgagaggcgtgtgcgcaggacgctgccctctgttgcccaaagcccgcaccaggctcctgggcttccgcgggcttccgcaggcctcaggcgaggggcggggacgccacccgcacgctcccgagcgcagggagggctgtcgccgaagcggtgacccacgcgtggaccccgcccgcgctgggccgggccggtcccctgcccacccgcagccctgctcggccgcgttcccagcagccgggaaagcttcctccctcggtcaccgatccaggccgctggtccagctgtcaaaacagggggtgtctctttcattctggctcacaaagtcccaaaggggaacagggggccttaatgcttgtgtttggacacaagcaattatccctaattattctttttcttttgagcctgcccgtcccgccggcgagcccgccgcggaacaggccccgtaatcctccctggtcggcggatctcagtgggctctgtgcggcccgaggctcgggcgctttcatgtcactgcgggtttagagctgattcaaactcattgcgatgggggaattaaccccggggcccgggctttcaggggcctctgataagagattatacgtgttgatggcaagcttttcttggcaaaatgttttcaaagggcttggagttgttaaatcaaagcgccattgaattgctcgggaccaccccctcccccgcctcttgcccttcccccacctccatctttttcccttcatccctcctcccccatcaccgcccaggactgcccaaggcgagcggcccagcctccgggagtggcgagtcaccttccttggtacgattttcccccggtgcctcgcccgggaaggattgtttttgtaggtgctcctgctgctgggcactttggtaccccttcccttccccgcccctccccgccccttcacacacacttgctctggtaaagaaaacatgtcccagatgaaagacgtttttttcaaacgtacatgtgttttgcagaaaacggaggtgacagggtgggataacgaggagaaaggaagggtggctttcctgcctcccccacccccgaaaggtcatcggagtcagaggggtaaccatcgggttaaaaagtattgtgggcagagttcagatgtccggtgaatcgcacggttctgccctgggggagatctgccttccacccccacccccgcggaatgacagaaagagttgggaggaccgtggggatgtagat

SEQ ID NO: 124625 - DNA, 233 bp, Homo sapiens
  misc_feature 1..233: note = chr5:72594173-72594406
  misc_feature 1..233: note = Hyper
  source 1..233: mol_type = genomic DNA
agagctgggacaaaacgccggagcggcccggcgggggacgcacaggcgagtctcagggccccgccctctcccgtgtccccctgttctgcgcgggcgggctgtgcgggcctggccaggagccgggtcggaactccgtgcagcgatggcagctcgggcgcgcgccttgaggagccggtggggtgctgggggacggagaaggtcccaaggtccggggcgcgcgctttgctgccgct

SEQ ID NO: 124626 - DNA, 1202 bp, Homo sapiens
  misc_feature 1..1202: note = chr5:72594770-72595972
  misc_feature 1..1202: note = Hyper
  source 1..1202: mol_type = genomic DNA
aaagagaaaaggcaccgggcacggaggtttaatgtgaagcatgtgagcggggctcagtttacaggtacgcgggccgatggcgaagagcgctgtcaagcggcctcgaggatttcggggggtttgcgccgccgaggaaaccctacccggacgaggcgagcagcctggtggccctggcggccgcgagctcccggctgccaccgctaggcgcccccgcccggcccgccggcgctccgagggcaaacccgggcggcacagccgtgcgccctgggctccgcgcgcccaaggaaagggcttcccagtcaccctgcggcgacgcttctccctcccgggaatgacaccttcgctcgctttcacacagccaagccgttggagaggcagaaacagtgggtcccgagcccgcaggagaagttcccatcccgcccctctagccctcgggcgttggcagtggagtaacaaagacgctgccgcgccgttgaccccgaagaagctctgatgaaaaggagggcgggccgcgggataggagtttctacaattagttttttctgcctttacgttcccaagaagaagccgaggaagtagaaaggagagagatctgggaaaggcaagatccagaaatcaggagccattatgtttctcattttggagaaaaactgtaaaacagctcggcctcttgtccaccttgccccgaaggcaagtctggatatgaaaagaaaaaggcgggcaacggaggagatttatttttcattttaactttcctctcccaggcttcctcaccccctgcccccttcgattcctaggaggggcggccccagccctcggagccgattctcggcgctgcgctaggacatcagaggcgatacaggttcgatgttaaatgaaccttcaggccgccggacaatggcgcagacctcacacgggggcaccgcgccttcccccagccgtgctcggctcccgccgcttctttatttcacgtggtggaatcctccgcgtctcctacagccgccgaaccaatgggcagaccggggagagcgggacgcgcaggagagggtttgaaaggaggtgtgggttttaatttttaaagagcataattgggctgaggagggttattttttccttggccacgggaaaaaaaagaggaagaaggggaaaaaaaagtcaggcgaaacacaacacatttatctatcaaccgctagacaagacaa

SEQ ID NO: 124627 - DNA, 134 bp, Homo sapiens; identical to SEQ ID NO: 94206
  misc_feature 1..134: note = chr5:72596806-72596940
  misc_feature 1..134: note = Hyper
  source 1..134: mol_type = genomic DNA

SEQ ID NO: 124628 - DNA, 72 bp, Homo sapiens; identical to SEQ ID NO: 7872
  misc_feature 1..72: note = chr5:72598030-72598102
  misc_feature 1..72: note = Hyper
  source 1..72: mol_type = genomic DNA

SEQ ID NO: 124629 - DNA, 871 bp, Homo sapiens
  misc_feature 1..871: note = chr5:72598987-72599858
  misc_feature 1..871: note = Hyper
  source 1..871: mol_type = genomic DNA
cgcaatgtggaagggcggcgagtcgccctcggggcccacagcgccgtcgggcaaagaaccagaggcgtggagcgaatgcagcgcccgggagtcagggctgttagtggcgtggcccgccgggcattgagctgtttcctccaacgcccggtcccccgcggcctaggcccagtgtttgcttttgcagatacgtcagagggaacattcaggaggggcgggctcccaggctcccaggagaccgcccggagcctccggagcgcgacgaggcgcggggcctcggagatctggcctgccagattgagggggaggggagggggcctggcccagcagctggacaggcgcgcagtgcccgcagcccgcgagtgggcgcccagctggcttcgcacgggtgaggggctcagcctgcacttccctcctccaccccgaccgccgaacgcgtcccggctggcttcagagtgcgcttctcgtggacgtgctgcgcgcaccctagggagatgcgcggcgtccgcgcgggtcagcgccccagtaccactccccagtgtactccccaggtacacgcttcccttgcgcggcgagtttcaactcaggtcagaacggagctgagcggtgggcggagtggagaaaggtcccggaaattggccaagagggggcggtttcgaggtagtgccttcgaagtgttgtccagaccagcagggagggtcgcctccacctgcggggcctcctccagctccacaaggtagccccgtagggacttgcagatctgccagacctagcagtgagaccactgctcccactgaatggcgccgcctgcgggctggcccaagctctatgcaccggctttatctcattttctcctcaccgttaataactggca

SEQ ID NO: 124630 - DNA, 30 bp, Homo sapiens; identical to SEQ ID NO: 7875
  misc_feature 1..30: note = chr5:72608427-72608457
  misc_feature 1..30: note = Hyper
  source 1..30: mol_type = genomic DNA

SEQ ID NO: 124631 - DNA, 1174 bp, Homo sapiens
  misc_feature 1..1174: note = chr5:72677145-72678319
  misc_feature 1..1174: note = Hyper
  source 1..1174: mol_type = genomic DNA
gctaaaattaatctgcgctgggccacttgcagaaagcagaaccacctcccgcccccacctcgcctccagccgccggggttcaggcgtttgtgaaagacagaacctttgggctagggacccgggcactggtgcttcgaagtccgaatccgccggccgagaaaacgacaagagaaagaaaatccagcgggcgctctctccagcgccaggccggtgtaggagggcgctggggctcggcctgccacccctacccgacattgggaagcagcccctgcgctcccgcggcgcctcagcctccggtccccgccccgaggtgcgcgttcctcctcccgcatgcccgtctcgggccccacggagcaagaagatagacgatgacgaggcgcgcccatccatccgggccgacgaggtcaggcccgcgccacaggcaaaaattgcgcaagcccggccgcagggatttcgcgggcgcctgggtcccaggtgcgcggccgaaatcctcagggaaaatcccgaggggccaacggtctaggccacagggctgctgggcccgggcctggctcagagcgcattcgggcggggaggccgcacgccgcacccgggcctctcctccgagcccgaggcaggcactgagctccgggccagccaggtgcctcccggctggtgcgagaccccgggcctgctgggaggcgtgggcagggcagggcagggctgaaccccagcgactgaatctcgaaggcaggaggcctcggaggtcatcggcccagctcgcctgaaactgtccctgctcgtgccagggcgcgggcagaggagaaaggacagggcggagcaagcccactgcagaactgcggtcggtggctgcgaagggtccgggtcaccgcgctcccggacgccggaagccgcgctggcggggccgcggggagggaggctgggtaccggggccgtccggccggaggaagcggctccggccgcgctgtccgcgcttgggagccgcgtgcagggttcagccgtgtttcagttgccctctgacctgaccccgggcgcacaaaggcctcccgggtgcgccgccatggcccagtcttccagtcgctgccaaattaatgagcccacgtcaggttgggtttacagctcggccgggaagcagccgagtggaaaatgagctcggggccgctccagaggctcc

SEQ ID NO: 124632 - DNA, 874 bp, Homo sapiens
  misc_feature 1..874: note = chr5:72715262-72716136
  misc_feature 1..874: note = Hyper
  source 1..874: mol_type = genomic DNA
gtagtggggagggggcgccaagagtaacaaagggagccagcggcctggtttgtttggattgccgggccggcgcgggagcggccgggcgcagctgaccacgggtacagataggttaatttccacatggagctgcagaaaccctatccgcgggttgcgaagcgtgggtcagccaaggcatgttaatctgtttagcatgtgcgccgcgcggaggagccagaccaccggggcgcaggaggcgcggccgcagccggcgctcctctgggggagttaataaagagcttaaggcaggcaagtaagtgtatggaggctgcgagcggcttcttgcgggcggcccgggggagggcgaggcccggctgcctgcgctcgcgttcccaggccctcggaaccgcgcgccctcgaggccgagcgagccccgccgcgccgagcctcccgggcgtccgcaggcctggcgcacaccgaagcggggggcgcagtactgctctcccgccccccggagccgagcctcttcgcgttcgcaccgtgaaaggaggggagcgaggggttagccatctcgaacatttttaactaatcaaaatatttgctgatgagtatttatttttacaagaactcggtttggctggagacttcccgagcaacaatatgggctgccgtattaggtttgtgacggagccaagtgtggttggggcttattgaatctgcgggccggagatcgctcgctccggagacgtttctccgttctggggaagcagctttcccaaaaccgtccttctgcagatggctcttagaacacaaccacatgtcccctaaagcacgggaagcttcgtgttttatgtttgggctgaatgaaaagaggaacgcacgctctttcctgccc

SEQ ID NO: 124633 - DNA, 30 bp, Homo sapiens; identical to SEQ ID NO: 94217
  misc_feature 1..30: note = chr5:72716375-72716405
  misc_feature 1..30: note = Hyper
  source 1..30: mol_type = genomic DNA

SEQ ID NO: 124634 - DNA, 30 bp, Homo sapiens; identical to SEQ ID NO: 29666
  misc_feature 1..30: note = chr5:72731806-72731836
  misc_feature 1..30: note = Hyper
  source 1..30: mol_type = genomic DNA

SEQ ID NO: 124635 - DNA, 152 bp, Homo sapiens; identical to SEQ ID NO: 94219
  misc_feature 1..152: note = chr5:72732228-72732380
  misc_feature 1..152: note = Hyper
  source 1..152: mol_type = genomic DNA

SEQ ID NO: 124636 - DNA, 555 bp, Homo sapiens
  misc_feature 1..555: note = chr5:72732630-72733185
  misc_feature 1..555: note = Hyper
  source 1..555: mol_type = genomic DNA
agcccggagcctctccgccccgccgggccccgcggccgccccttcctcacccggaaaatcgtggggaggcgcggcgtagcggccggacccctggcctccgcgtcgggctgcgccacgtggcagctcccagcgccctcccgtcccggcctcgcatgctgtcgggggagcgcctcgtcccactcaggccgaaaccccaggaaggaaatcactctgggctggggacgcggcctttctgctcgcggctgttgggtgatgtgcccgaggtttctctgcccttctccgggcgcaggccgttcattcgcgccgccgctcctgagggtcgctgggcgcagaaccgcctcggccgcggcccggccttaggcgcggcctcgcgcattcctgcgctcgccacagccggcgggaggcggggaagggagcagcccgggtggcttggagaacactgaacctttaattgggctataaatcagacaggggagtgcggtggagtttatgcaggtgtaaaaacagaggggaaagcccgggccgagcagccaaagcgcccgggcaggtcagaac

SEQ ID NO: 124637 - DNA, 87 bp, Homo sapiens; identical to SEQ ID NO: 94222
  misc_feature 1..87: note = chr5:72733501-72733588
  misc_feature 1..87: note = Hyper
  source 1..87: mol_type = genomic DNA

SEQ ID NO: 124638 - DNA, 245 bp, Homo sapiens; identical to SEQ ID NO: 94223
  misc_feature 1..245: note = chr5:72740103-72740348
  misc_feature 1..245: note = Hyper
  source 1..245: mol_type = genomic DNA

SEQ ID NO: 124639 - DNA, 1912 bp, Homo sapiens; identical to SEQ ID NO: 94224
  misc_feature 1..1912: note = chr5:72742569-72744481
  misc_feature 1..1912: note = Hyper
  source 1..1912: mol_type = genomic DNA

SEQ ID NO: 124640 - DNA, 499 bp, Homo sapiens; identical to SEQ ID NO: 94225
  misc_feature 1..499: note = chr5:72744697-72745196
  misc_feature 1..499: note = Hyper
  source 1..499: mol_type = genomic DNA

SEQ ID NO: 124641 - DNA, 46 bp, Homo sapiens
  misc_feature 1..46: note = chr5:72746678-72746724
  misc_feature 1..46: note = Hyper
  source 1..46: mol_type = genomic DNA
tcattccgttcatggcgcgggagatagactgcgttcgtttgtaact

SEQ ID NO: 124642 - DNA, 528 bp, Homo sapiens; identical to SEQ ID NO: 94227
  misc_feature 1..528: note = chr5:72746992-72747520
  misc_feature 1..528: note = Hyper
  source 1..528: mol_type = genomic DNA

SEQ ID NO: 124643 - DNA, 30 bp, Homo sapiens; identical to SEQ ID NO: 94228
  misc_feature 1..30: note = chr5:72747820-72747850
  misc_feature 1..30: note = Hyper
  source 1..30: mol_type = genomic DNA

SEQ ID NO: 124644 - DNA, 104 bp, Homo sapiens; identical to SEQ ID NO: 94234
  misc_feature 1..104: note = chr5:74061423-74061527
  misc_feature 1..104: note = Hypo
  source 1..104: mol_type = genomic DNA

SEQ ID NO: 124645 - DNA, 67 bp, Homo sapiens; identical to SEQ ID NO: 29677
  misc_feature 1..67: note = chr5:74161713-74161780
  misc_feature 1..67: note = Hyper
  source 1..67: mol_type = genomic DNA

SEQ ID NO: 124646 - DNA, 35 bp, Homo sapiens; identical to SEQ ID NO: 94236
  misc_feature 1..35: note = chr5:74162202-74162237
  misc_feature 1..35: note = Hyper
  source 1..35: mol_type = genomic DNA

SEQ ID NO: 124647 - DNA, 110 bp, Homo sapiens; identical to SEQ ID NO: 94237
  misc_feature 1..110: note = chr5:74162506-74162616
  misc_feature 1..110: note = Hyper
  source 1..110: mol_type = genomic DNA

SEQ ID NO: 124648 - DNA, 381 bp, Homo sapiens; identical to SEQ ID NO: 94238
  misc_feature 1..381: note = chr5:74348254-74348635
  misc_feature 1..381: note = Hyper
  source 1..381: mol_type = genomic DNA

SEQ ID NO: 124649 - DNA, 511 bp, Homo sapiens; identical to SEQ ID NO: 94239
  misc_feature 1..511: note = chr5:74349496-74350007
  misc_feature 1..511: note = Hyper
  source 1..511: mol_type = genomic DNA

SEQ ID NO: 124650 - DNA, 25 bp, Homo sapiens
  misc_feature 1..25: note = chr5:74536034-74536059
  misc_feature 1..25: note = Hypo
  source 1..25: mol_type = genomic DNA
aatttttttttgagacggagtttcg

SEQ ID NO: 124651 - DNA, 125 bp, Homo sapiens; identical to SEQ ID NO: 94241
  misc_feature 1..125: note = chr5:74906134-74906259
  misc_feature 1..125: note = Hypo
  source 1..125: mol_type = genomic DNA

SEQ ID NO: 124652 - DNA, 104 bp, Homo sapiens; identical to SEQ ID NO: 94242
  misc_feature 1..104: note = chr5:74907576-74907680
  misc_feature 1..104: note = Hyper
  source 1..104: mol_type = genomic DNA

SEQ ID NO: 124653 - DNA, 42 bp, Homo sapiens; identical to SEQ ID NO: 94243
  misc_feature 1..42: note = chr5:75014106-75014148
  misc_feature 1..42: note = Hypo
  source 1..42: mol_type = genomic DNA

SEQ ID NO: 124654 - DNA, 613 bp, Homo sapiens
  misc_feature 1..613: note = chr5:75377684-75378297
  misc_feature 1..613: note = Hyper
  source 1..613: mol_type = genomic DNA
accgcctgtctccaccggctcctctgggcaggaggctccagcctgggggtgcctgacagctctccttccccggcgcctgtattatacatgtaacatttatatttctatccacacagcgttcattcagccatccattcaatcacccaggcatatttacacggatggaacacattcgcggagagatgtgtgtgtttgagttccaatcactgcagcccgtattggcgcggcgctttgtctcgctttgggtcaccaccacaggagcaacgatttcggggacggcacacgcctgtgtgaccgcttcccactccacttgggttccgtgagcgcgcggagccggaggagtcagggacgtgaggatgccctacttcccgcagcatccggatggcagggtctgcgtcggaaggcccgggagggcgacgccctccactgctgccgcggggtgggtgcgccaggcctgggtgtggcctcacgggagcgagtttctctccagccgcctggcccaccgctttggaacagtgaagctcgagttggggtctcctgcacgccaaggggagaaatgtttgtttctgacaacacaagcaaaattctctctcctgcacgccaaggggagaaa

SEQ ID NO: 124655 - DNA, 155 bp, Homo sapiens; identical to SEQ ID NO: 94246
  misc_feature 1..155: note = chr5:75378559-75378714
  misc_feature 1..155: note = Hyper
  source 1..155: mol_type = genomic DNA

SEQ ID NO: 124656 - DNA, 689 bp, Homo sapiens; identical to SEQ ID NO: 29683
  misc_feature 1..689: note = chr5:75379005-75379694
  misc_feature 1..689: note = Hyper
  source 1..689: mol_type = genomic DNA

SEQ ID NO: 124657 - DNA, 857 bp, Homo sapiens; identical to SEQ ID NO: 94248
  misc_feature 1..857: note = chr5:75380067-75380924
  misc_feature 1..857: note = Hyper
  source 1..857: mol_type = genomic DNA

SEQ ID NO: 124658 - DNA, 36 bp, Homo sapiens; identical to SEQ ID NO: 94249
  misc_feature 1..36: note = chr5:75587117-75587153
  misc_feature 1..36: note = Hypo
  source 1..36: mol_type = genomic DNA

SEQ ID NO: 124659 - DNA, 21 bp, Homo sapiens
  misc_feature 1..21: note = chr5:75688128-75688149
  misc_feature 1..21: note = Hypo
  source 1..21: mol_type = genomic DNA
acagagcgagactccgtctca

SEQ ID NO: 124660 - DNA, 30 bp, Homo sapiens; identical to SEQ ID NO: 94251
  misc_feature 1..30: note = chr5:75698244-75698274
  misc_feature 1..30: note = Hyper
  source 1..30: mol_type = genomic DNA

SEQ ID NO: 124661 - DNA, 714 bp, Homo sapiens; identical to SEQ ID NO: 94252
  misc_feature 1..714: note = chr5:75699459-75700173
  misc_feature 1..714: note = Hyper
  source 1..714: mol_type = genomic DNA

SEQ ID NO: 124662 - DNA, 17 bp, Homo sapiens
  misc_feature 1..17: note = chr5:75719149-75719166
  misc_feature 1..17: note = Hypo
  source 1..17: mol_type = genomic DNA
aaaatggtgcttggtcg

SEQ ID NO: 124663 - DNA, 76 bp, Homo sapiens; identical to SEQ ID NO: 94254
  misc_feature 1..76: note = chr5:75743288-75743364
  misc_feature 1..76: note = Hypo
  source 1..76: mol_type = genomic DNA

SEQ ID NO: 124664 - DNA, 30 bp, Homo sapiens; identical to SEQ ID NO: 40558
  misc_feature 1..30: note = chr5:75819580-75819610
  misc_feature 1..30: note = Hypo
  source 1..30: mol_type = genomic DNA

SEQ ID NO: 124665 - DNA, 30 bp, Homo sapiens; identical to SEQ ID NO: 94256
  misc_feature 1..30: note = chr5:75913911-75913941
  misc_feature 1..30: note = Hypo
  source 1..30: mol_type = genomic DNA

SEQ ID NO: 124666 - DNA, 89 bp, Homo sapiens; identical to SEQ ID NO: 40559
  misc_feature 1..89: note = chr5:75963986-75964075
  misc_feature 1..89: note = Hypo
  source 1..89: mol_type = genomic DNA

SEQ ID NO: 124667 - DNA, 40 bp, Homo sapiens; identical to SEQ ID NO: 94258
  misc_feature 1..40: note = chr5:75965679-75965719
  misc_feature 1..40: note = Hypo
  source 1..40: mol_type = genomic DNA

SEQ ID NO: 124668 - DNA, 30 bp, Homo sapiens; identical to SEQ ID NO: 40560
  misc_feature 1..30: note = chr5:75969716-75969746
  misc_feature 1..30: note = Hypo
  source 1..30: mol_type = genomic DNA

SEQ ID NO: 124669 - DNA, 30 bp, Homo sapiens; identical to SEQ ID NO: 94260
  misc_feature 1..30: note = chr5:75996136-75996166
  misc_feature 1..30: note = Hypo
  source 1..30: mol_type = genomic DNA

SEQ ID NO: 124670 - DNA, 580 bp, Homo sapiens; identical to SEQ ID NO: 94261
  misc_feature 1..580: note = chr5:76011174-76011754
  misc_feature 1..580: note = Hyper
  source 1..580: mol_type = genomic DNA

SEQ ID NO: 124671 - DNA, 35 bp, Homo sapiens; identical to SEQ ID NO: 94262
  misc_feature 1..35: note = chr5:76012164-76012199
  misc_feature 1..35: note = Hyper
  source 1..35: mol_type = genomic DNA

SEQ ID NO: 124672 - DNA, 41 bp, Homo sapiens; identical to SEQ ID NO: 94263
  misc_feature 1..41: note = chr5:76012602-76012643
  misc_feature 1..41: note = Hyper
  source 1..41: mol_type = genomic DNA

SEQ ID NO: 124673 - DNA, 30 bp, Homo sapiens; identical to SEQ ID NO: 94264
  misc_feature 1..30: note = chr5:76114850-76114880
  misc_feature 1..30: note = Hyper
  source 1..30: mol_type = genomic DNA

SEQ ID NO: 124674 - DNA, 63 bp, Homo sapiens; identical to SEQ ID NO: 94265
  misc_feature 1..63: note = chr5:76115162-76115225
  misc_feature 1..63: note = Hyper
  source 1..63: mol_type = genomic DNA

SEQ ID NO: 124675 - DNA, 166 bp, Homo sapiens; identical to SEQ ID NO: 94266
  misc_feature 1..166: note = chr5:76115443-76115609
  misc_feature 1..166: note = Hyper
  source 1..166: mol_type = genomic DNA

SEQ ID NO: 124676 - DNA, 871 bp, Homo sapiens
  misc_feature 1..871: note = chr5:76249279-76250150
  misc_feature 1..871: note = Hyper
  source 1..871: mol_type = genomic DNA
ccttcccgtcttctccggacacgggaaaacattacccctctctctttattcgctatgctgagtggcagggagggtgccccgctcctggtccccttttttatccccagcccttgaacttttccggactgacctatgtttcttgccagctgagggaagcggcggactacgatcctttcctgctcttcagcgccaacctgaagcgggagctggctggggagcagccgtaccgccgcgctctgcgtgagtcgaggctgcccggctcgcgggcgcccgggacgcggggaaggtgggactctgtgcggggggcagagggctcgcggacatctcggggaaggggctggccggaaccgccaggggcgcggtccccttagctaaggatcggtccgcggaggcgcgccaggagcgggagagggtggcgcgcccggggcgcaggaacccagcgcagcctaggctggaagtcggggcgctgggcactacagagcccgggaatggggcgcgcggagagcggccgcccgaggacggcgctgcggcggctgcagcccgggacttattgccccatgccctcctcccccagggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtgaggcgcccacggccagccaacctagccggagggcggcacgggagggttggaaagggctggggcgctgcacccagcgtggggctgctgagcgtaggtagccagtggcacttcttagacacttcgctggtgcccgagt

SEQ ID NO: 124677 - DNA, 236 bp, Homo sapiens; identical to SEQ ID NO: 94270
  misc_feature 1..236: note = chr5:76250409-76250645
  misc_feature 1..236: note = Hyper
  source 1..236: mol_type = genomic DNA

SEQ ID NO: 124678 - DNA, 30 bp, Homo sapiens; identical to SEQ ID NO: 40561
  misc_feature 1..30: note = chr5:76327167-76327197
  misc_feature 1..30: note = Hypo
  source 1..30: mol_type = genomic DNA

SEQ ID NO: 124679 - DNA, 26 bp, Homo sapiens
  misc_feature 1..26: note = chr5:76327430-76327456
  misc_feature 1..26: note = Hypo
  source 1..26: mol_type = genomic DNA
aaccttggctggacgcggtagctcac

SEQ ID NO: 124680 - DNA, 25 bp, Homo sapiens
  misc_feature 1..25: note = chr5:76327696-76327721
  misc_feature 1..25: note = Hypo
  source 1..25: mol_type = genomic DNA
ccagccagggcgacagagtgcaact

SEQ ID NO: 124681 - DNA, 30 bp, Homo sapiens; identical to SEQ ID NO: 94274
  misc_feature 1..30: note = chr5:76475962-76475992
  misc_feature 1..30: note = Hyper
  source 1..30: mol_type = genomic DNA

SEQ ID NO: 124682 - DNA, 556 bp, Homo sapiens; identical to SEQ ID NO: 94275
  misc_feature 1..556: note = chr5:76476235-76476791
  misc_feature 1..556: note = Hyper
  source 1..556: mol_type = genomic DNA

SEQ ID NO: 124683 - DNA, 1057 bp, Homo sapiens
  misc_feature 1..1057: note = chr5:76506145-76507202
  misc_feature 1..1057: note = Hyper
  source 1..1057: mol_type = genomic DNA
gccgagccgcgggcacgctctgccctgtcgggagagctccgggagcggcgggaggggcggaggggcgcagtggggcccgggcggctgcggccgcggagccggggcacctgaggaggaaggagggtgggagcgagggagggaggggacgggcgcagaccgaaagtggggaaagaaggtgcaggcaggcgggcaggcgggcgggcgccctggcccagggccgcgggtgcgggagcccggcgaggtcgagctgggcggcggcgggggccgcgccgagggaggaggggaaggcggaggcgcggggagcgtgtttggggcgccgcggcggggagggtggcggccgctggtgcgcgcggggcgctgtgtatgcgcgctcccccgctcggggaggaagatggcccaaaagggaaagttggggtgacgcgcgcggtccccggaggctcggcggggggcaccgcggccagcccgacggagcggcggacacacaggccggggggcgcgcagtccgggcgccgccgcggccgccccctcactgcaggtggcagcgggtgcgctgggtcccggcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaaggtaaatgccccgcgctggcacacgccgtgggggccgtccgccccgtcggcggggctcgcacgggtagggggctccggcggagttgggtgaccgtgaggcggttggtttggaga

SEQ ID NO: 124684 - DNA, 30 bp, Homo sapiens; identical to SEQ ID NO: 94278
  misc_feature 1..30: note = chr5:76507421-76507451
  misc_feature 1..30: note = Hyper
  source 1..30: mol_type = genomic DNA

SEQ ID NO: 124685 - DNA, 801 bp, Homo sapiens
  misc_feature 1..801: note = chr5:76923679-76924480
  misc_feature 1..801: note = Hyper
  source 1..801: mol_type = genomic DNA
ggaagcctgtgatatcgatttgcctccaagtttaaaacacaccgcaaaccttcccctcggccgaccgaagaaacggcatttttttcctactcctttggggcagtcccctgagcacgtgcctgaagtcgaggttagtacgcagccagcagggaccctgacaggaaaccagagcagccccggggttgggggagccctggtaggtgctggtcgtcccggacacgcctcttctggagaagcgcgtttgtcccttacttgggaggtcccgggtatctgaagcggatcccgggtctggggacatgaaggggcgccgtggccttagggaaggccccaaagaggcctaggccccggaggaggcaagagccgcggcctagcttccaccgcgtacctggggccagacacggctggggcggcgccggagagcagaactccaggctctgaaggccgagggtgcgaattgtggtcccctcccacccacggcctccccatcacgcgcacgcagcccgcgaggggcgccctccgcgccactgccccagggacaccgttcatctgaggaactctcgcgccctgcgtttcgtgccgacagcgacgctcggagtcccacctgggaaacctgggttggcccggaaacctcgggaggctcagagcttgcgtgaggcgctcgcggcgccccagcatgccgccccgtcgcggagacctcaccttgcagcccagaaaccgaacccaagcccactgcagggcgaagggcccacgcgttccaactggcgcgaatataaccattcccaagaccggcccctcccctcc

SEQ ID NO: 124686 - DNA, 167 bp, Homo sapiens; identical to SEQ ID NO: 29701
  misc_feature 1..167: note = chr5:76924754-76924921
  misc_feature 1..167: note = Hyper
  source 1..167: mol_type = genomic DNA

SEQ ID NO: 124687 - DNA, 1402 bp, Homo sapiens; identical to SEQ ID NO: 94283
  misc_feature 1..1402: note = chr5:76925454-76926856
  misc_feature 1..1402: note = Hyper
  source 1..1402: mol_type = genomic DNA

SEQ ID NO: 124688 - DNA, 783 bp, Homo sapiens; identical to SEQ ID NO: 94284
  misc_feature 1..783: note = chr5:76928157-76928940
  misc_feature 1..783: note = Hyper
  source 1..783: mol_type = genomic DNA

SEQ ID NO: 124689 - DNA, 30 bp, Homo sapiens; identical to SEQ ID NO: 94285
  misc_feature 1..30: note = chr5:76929223-76929253
  misc_feature 1..30: note = Hyper
  source 1..30: mol_type = genomic DNA

SEQ ID NO: 124690 - DNA, 1237 bp, Homo sapiens
  misc_feature 1..1237: note = chr5:76932282-76933519
  misc_feature 1..1237: note = Hyper
  source 1..1237: mol_type = genomic DNA
tatttgtcaataatgcgagcaggagttgaggtgtgcgctcggctgggccgcccgggggggcgctgaggttgccttctcaggcggaggaggcgaaccctgtagcccgacaacgccgggcttcgattttgaggagcttcttccgggatgtcgctatactggccggagacgggccttgcgtgtccattgggggatggcgatggggaccagtttccgggtagagaaggagataactcgatacaggaacgcacaggcagcctgaaagcagcccaggatctcgacaggggaagggaagaccctgctccctttgcccaaatcctcccgccctgtccttgccttctgtcccagatcccaagcccctcgtacctgcactcgggactcggtcagcccgatacgcagtgccagctcctcacgcataaagatgtcggggtagtgagtcttggcgaagctcctctccaactcgttgagctgtgcgggggtgaagcgcgtccggtggcgcttctgcttctgttggccctgctgctggccggcttggctggggttcgggccgccctggggcccgggctgcttgtccgggtctttggcgctcaccgccagcgaggccggagtagagcccactgtggtgatgtcctccccgggcagcagagtggctccctccactgggtcagagttgggcgccaggtcccccggatggcccccggggtcggagccccccacgcccagcctacacttcaccgcctcccggtggcccagaagctcggcggcatctttcatacctgaggaggcaaggggatcgcggtcactactttcttggcgatgccaggaggggctgtcttccccgcgcagccttccttcaacccgtcctcggccccctccgcacccgcgcttgtcctaaggaagaaactcccagggtattcagctgggttccccagaatttggacagccgggttggaataatatctcccggccccttgccctcgccgcagccggctcccgtagtaaacagcacaagctttcgtctctcccacaataaaacactcccagtcccggcaataaaacatgcctctgaatcccttccataaaccgtaccccaggcgccccaggaaatcgagagcaaatctttggacacaggggtgcggggggcagaaagaaaattaaacaattcctcggttgctgcggcacctgcgcttcggcagcctgacgaactgtacctccggccctcagccgattccctcttact

SEQ ID NO: 124691 - DNA, 30 bp, Homo sapiens; identical to SEQ ID NO: 94288
  misc_feature 1..30: note = chr5:76933770-76933800
  misc_feature 1..30: note = Hyper
  source 1..30: mol_type = genomic DNA

SEQ ID NO: 124692 - DNA, 1258 bp, Homo sapiens
  misc_feature 1..1258: note = chr5:76934040-76935298
  misc_feature 1..1258: note = Hyper
  source 1..1258: mol_type = genomic DNA
cctaacaaattatcacggggtatatcgcctttcgaaaaaaaaaaaaaggcgggggaggggggaagagaaaaataagaaaaacaaaaagtaacaacattccccaactcctttcttggatctacatattccatagatttttttttaaaggcgatgttaaatcaaattaaactttaatgcagcacaattacttttaaagaaattagtccatttaggtcgcattaaggtaaaataaggaacaaattgacaatttcctgccccggcttctcctggctgcccgggcgagaggcgcgcactcacctagcctggcgtccaggaggtcggcatgagacagcatcgcgcaccgctccagggcgaaagctgttcccccccaaattttagcggctttaagttatttaaaatagatataagctataagctatacgatatagatatatatagatcacctaaatgaaagaaaattcggtttgtggttaaaaagggggcttcttgcattataatgtcctttagagagacggggaggtgcttaacagttgaatgaacccgtgagcagctcggcgaggggaccaatcaggagggcagcctgcaaatgtcagcgcccggagagtcccccactccgcccgcccgctcgcctgcgcccgcctgaaggaggcggcggcggcagccctggcagctccagcccggagcaggagctaaagcagcctcagccgcctcggcctcgccctgagcttctgggcccggctccctctagttcttccctgcgattttctccaggctcccctttccttccccttggccggcgctgcgcgcttcgaaggcgtagctctgtgcctctgagctaacatcttcctagggcaggggcagagcaggggtcagagcgggccatgaccctggcgtgacctgagggtcgcccccacctgcgctctctgggcctgccgctcatattggcccgccagcccagggcgcgacgagggcacaccgcggccttcagacaacgcctggacttcgccgcggctcagtaggcctgcgcctagggtccaggcgccctggctgtgccctggggtctatacgagccccaaccccacagtgggcctagagcgcaaagaggagtcggcttccctggcaccgccagcgcccgctgtctgctttggggaccctcgcggagtgtgggttcgagcgctctgcactcttctcaccgggcttcttcccggctcctgctcttccgcttggcccacgcccgcatcctcgcccctaactcgct

SEQ ID NO: 124693 - DNA, 799 bp, Homo sapiens; identical to SEQ ID NO: 94291
  misc_feature 1..799: note = chr5:76936016-76936815
  misc_feature 1..799: note = Hyper
  source 1..799: mol_type = genomic DNA

SEQ ID NO: 124694 - DNA, 49 bp, Homo sapiens
  misc_feature 1..49: note = chr5:76937397-76937446
  misc_feature 1..49: note = Hyper
  source 1..49: mol_type = genomic DNA
gctcccccctgctcccggttccctctcggtagctcgttttggccaatgt

SEQ ID NO: 124695 - DNA, 30 bp, Homo sapiens; identical to SEQ ID NO: 94293
  misc_feature 1..30: note = chr5:76938430-76938460
  misc_feature 1..30: note = Hyper
  source 1..30: mol_type = genomic DNA

SEQ ID NO: 124696 - DNA, 393 bp, Homo sapiens
  misc_feature 1..393: note = chr5:76939420-76939813
  misc_feature 1..393: note = Hyper
  source 1..393: mol_type = genomic DNA
caggatccccagcctcggagccaaatgccaagcaacgttcaggatccacacttggggctttctttctgttttttaaacgccggtagcaggctgcgtgtgcatgacacgtgtacttgtgtgtgcttgtgcgagcagtgcgtgttccttgcctgttcactcacacggagggggcatgccaggcgctgcggaggggcagaaacctgccccaaagagtctcatttcctatcccacccagaagcctttcgcaatacacgagctcgacatatacacttttttcttttctgcagtaaacagtttcccacacattcgagtttgcaaacttcaaccagacagtccacccgcctgacttttcgtgggtgcaagggccggtcccttgctcgttttttctcccat

SEQ ID NO: 124697 - DNA, 151 bp, Homo sapiens; identical to SEQ ID NO: 94295
  misc_feature 1..151: note = chr5:76940344-76940495
  misc_feature 1..151: note = Hyper
  source 1..151: mol_type = genomic DNA

SEQ ID NO: 124698 - DNA, 1044 bp, Homo sapiens
  misc_feature 1..1044: note = chr5:76940857-76941901
  misc_feature 1..1044: note = Hyper
  source 1..1044: mol_type = genomic DNA
ccctcgtcccctccccgcaacccgagtgcggctaattccgggcgtctatattcactcaattagagaaatctacagagaagatcgatcttccatctgcagacatgccagcttaacaaattagattcttgtttcgtgcaggtgatttggtgacagttggggaattagaagtaataagttgttgtgtttgagcccgggcccccgccccccgcccgcgcccctccccgcccgggggcccctcggccgcgcccgccgcccgggcaccccctaccgcaccccccagccggcccgcgccgccgccgccgtcgccgcatcccccgccgtaattagtgctgctgccctccatgtgggctcgattaaaccgtgatttagccgaaagaaatataattatggctgcaaataaaataatcagcattgaagagcgatttccttaatgagatggagcggttgcacgtcacggagtaaaggggtctcattaagaggtggtaatgaggcttgggtggatggtgcagttacaaaatagcccaactcctctgcaggccgggcccgtccgcccgaagtggccgccgcgtcgccttccagcggtccggaggtgccgcggtcccagaggggactcgggcccgccccgcccggcccccagggggcgcagcgcccgcagcgcggcctcctcccggcgtctcccgcgccgtcgggccgggcgggggacacaagccgccgcagcggctagggggccccgccagcccggcccgctccgcctcggctgggcggccgggttggcacaagcaactgccaggcccccgaacactggagaagccggcccgagggaggggcccttgcctggggcgggtgccgagggtcagtccaggaaacttctggaacaggtggaagtcctcccgggtagatgtgagctccatcgggaaaagggtgtcacaaaaacaggtgctcagaggcaggggtgccaccgcggcaccccagaaccccgggtcagctcgcgcggacaccgcgtctgggagtcctggcgtggaagggcctcgggggttctcattc

SEQ ID NO: 124699 - DNA, 23 bp, Homo sapiens
  misc_feature 1..23: note = chr5:77047288-77047311
  misc_feature 1..23: note = Hypo
  source 1..23: mol_type = genomic DNA
caccgcgccggccagcctgacca

SEQ ID NO: 124700 - DNA, 244 bp, Homo sapiens; identical to SEQ ID NO: 94299
  misc_feature 1..244: note = chr5:77140527-77140771
  misc_feature 1..244: note = Hyper
  source 1..244: mol_type = genomic DNA

SEQ ID NO: 124701 - DNA, 616 bp, Homo sapiens
  misc_feature 1..616: note = chr5:77147516-77148132
  misc_feature 1..616: note = Hyper
  source 1..616: mol_type = genomic DNA
cggcgtgcatgtgtgcgtgtgtgcacgcgcgagaagtgcgtgtgtaggcgcgtgtgcaagtgcgcgcgcgtgtgtttacacttccagaagtcaaatcctttctaggactcccccttgcttcacccggaagtgttcggtgacccctccacccaattaatgaaaacaaagcaaagggcccgagcgggcctccgacagcccggggcttgcggagctggacgccgacagggcgtcagcccggtcgctcgcggcgcggaggctgctgcggttcggagctggggttctgcactctcgctcccggctcccggctcccggctccccgccacccgcagcctcctcgcgccgccgccgcgggcaccgccggggcttcagtgacaccaggcacccgccccgggccgcgggaggaggaaattccctgcaaaatagcaatggttccgagaaaaggatcacaacaaaatattgaataaattcccttttaatttatttgatcattccacattacggggctatgaattgctcaaatttgataacaagtactcaattcaactcattatgtaagttaaattagacttcgataaaatttcagtggcgcgcagtggttcctcgaatgaaatgtaat

SEQ ID NO: 124702 - DNA, 283 bp, Homo sapiens; identical to SEQ ID NO: 94302
  misc_feature 1..283: note = chr5:77148386-77148669
  misc_feature 1..283: note = Hyper
  source 1..283: mol_type = genomic DNA

SEQ ID NO: 124703 - DNA, 135 bp, Homo sapiens
  misc_feature 1..135: note = chr5:77253883-77254018
  misc_feature 1..135: note = Hyper
  source 1..135: mol_type = genomic DNA
ggagcgggaggctctcggcccgccgctcgcgggaacccccacctcgggcggccgggagggcagttggtggcggcgtggcctctttgtccccgtcagcccgaggcggcgctggtgcccacccggcctccccgtggc

SEQ ID NO: 124704 - DNA, 1080 bp, Homo sapiens
  misc_feature 1..1080: note = chr5:77268367-77269447
  misc_feature 1..1080: note = Hyper
  source 1..1080: mol_type = genomic DNA
gctggagagttacaccgagtcaacgcgggacacggctcccggcccgggccgggccaggggtgggaggcggttccctaccgcaggcggcgggactcccatgcgccgagggacccaagtctccactccacccacacgcccacccggcgtcggggcgctgcggcctcgcctcacgagcccagagcaggccgcagcctgggctggggatccggcacctgggcagggtgagcttggccggacatcctcctccaggactacccgcaccccacagtcgcgtcaaaagcgccccatccccctgtctctcgccgcgcaggtttcccaccgacgcccgctcggaaggcgagagcccccacgtggcccggcgcggcgcggcccccggggaccgcgagcaacaaaagcccggcccgcagcccctgctcctcgccttccttttcaattctcccctgatctcaggtggaattaggaggattaaagcagcaagtaaatgaggcgagtgtgcaaaatgactcctttctgaaccaaacggcatgctccgtgctggggaaatgagatgcacatttaaatctcatccatccaccgcctgcggccaccgccatgtacctgcctacttagcccaagggttaattaattgaggcttcaatgcactattgcaagagcattattgcatttgatactctacatctgtgatttaaaactctttcagtcccttgtcagcaagggagggtttttaactaggaaattagcattcagataagggaacgctctatttgcttctgaaaggaaggaaatattaaggatgctggtgcacaaaccgggctgtcatatcctgtcccatcctggagggagcgcgagggcccggctcctctgggagtggcggcgacagggcgtcgtgcaatggacgccagcaccaggggcgggctggagggggaccggcgatcagggaaaccttactcctcgcaggcttcaacctgctggggcgtgtttacgtccgcaaagtccgataatatattttgtccccacttcttaggagctgattcttcttaaaatgcattgccacgttatctctaacgttggctttctgac

SEQ ID NO: 124705 - DNA, 90 bp, Homo sapiens; identical to SEQ ID NO: 94308
  misc_feature 1..90: note = chr5:77655493-77655583
  misc_feature 1..90: note = Hypo
  source 1..90: mol_type = genomic DNA

SEQ ID NO: 124706 - DNA, 97 bp, Homo sapiens
  misc_feature 1..97: note = chr5:77806223-77806320
  misc_feature 1..97: note = Hyper
  source 1..97: mol_type = genomic DNA
aggggagagggagggcggttagcagcgccgccaggccccgccccgccttcccgccgcgcagcgacaccgtccaagtccggcccgtgcccgcagaacc

SEQ ID NO: 124707 - DNA, 30 bp, Homo sapiens; identical to SEQ ID NO: 94310
  misc_feature 1..30: note = chr5:77943372-77943402
  misc_feature 1..30: note = Hyper
  source 1..30: mol_type = genomic DNA

SEQ ID NO: 124708 - DNA, 106 bp, Homo sapiens; identical to SEQ ID NO: 94311
  misc_feature 1..106: note = chr5:78105439-78105545
  misc_feature 1..106: note = Hypo
  source 1..106: mol_type = genomic DNA

SEQ ID NO: 124709 - DNA, 878 bp, Homo sapiens
  misc_feature 1..878: note = chr5:78407583-78408461
  misc_feature 1..878: note = Hyper
  source 1..878: mol_type = genomic DNA
ccccacgcccaactgcgggtataaagaggcaggctgcggactcggagcagctcggggctgcgcagcgggaaggctcgcctagtcggtccgcatccgtgtcgaccacctgtctggacaccacgaagatgccacccgttgggggcaaaaaggccaagaaggtgagtctccaggggacccgagggcgctctccttcccctcccacctgctctgtatcccagcctctgggagcgcagaggggccctcggaccctgcctggtacccatcatcctcctactccctcccctccctcagcctcagaccagaatgtgcttccagaacttctccagcaggaccccaaggcgcctctgagcctccccactcctgccccacgttcagagcgcgcccccagagcgcctctgtcccctccagccccagcccagcttggaccagagtgcgccccagatctatgtgatccttgcctctcagacccaaaggcaccctctgagccctccctgacggctgggtgtccccagaactccgagccttccaatatcttctgaatctggcaccccaagaccagaaaactccctagagatactgctcctagccccgcaggcgcgatatcccgtccccacggagcccctccgcatctgtgtccgaggccgccgcgagcgccctctgcacccggcgcgcccagaacagggaggagtgcacggcgctggctccgacatttcccgcctggatctgcaccgcgggtgtcggggccgcctccccgccgggttctcgctgcacccaaggcccaggcgctggttgggtgattgcagattttcacaggcaatttgatgtccgtgatgacagaaaaatgtcatccgaaatgtcagcctcgaaaacatggttta

SEQ ID NO: 124710 - DNA, 20 bp, Homo sapiens
  misc_feature 1..20: note = chr5:78469259-78469279
  misc_feature 1..20: note = Hypo
  source 1..20: mol_type = genomic DNA
agtatttttctatttcgaaa

SEQ ID NO: 124711 - DNA, 30 bp, Homo sapiens; identical to SEQ ID NO: 94319
  misc_feature 1..30: note = chr5:78533526-78533556
  misc_feature 1..30: note = Hyper
  source 1..30: mol_type = genomic DNA

SEQ ID NO: 124712 - DNA, 115 bp, Homo sapiens; identical to SEQ ID NO: 40564
  misc_feature 1..115: note = chr5:78552615-78552730
  misc_feature 1..115: note = Hypo
  source 1..115: mol_type = genomic DNA

SEQ ID NO: 124713 - DNA, 35 bp, Homo sapiens; identical to SEQ ID NO: 40565
  misc_feature 1..35: note = chr5:78881941-78881976
  misc_feature 1..35: note = Hypo
  source 1..35: mol_type = genomic DNA

SEQ ID NO: 124714 - DNA, 165 bp, Homo sapiens; identical to SEQ ID NO: 94322
  misc_feature 1..165: note = chr5:78985096-78985261
  misc_feature 1..165: note = Hypo
  source 1..165: mol_type = genomic DNA

SEQ ID NO: 124715 - DNA, 566 bp, Homo sapiens
  misc_feature 1..566: note = chr5:79330913-79331479
  misc_feature 1..566: note = Hyper
  source 1..566: mol_type = genomic DNA
ctttctctccagccccgactgcccatcttcgcccctaccctcgcgcgtcggggccgtgtctacacccaccccaggacctggtccgtccaggctccttcccatcctcacacccgcgcctttctccctgcggccccggctcgctgctccagctgcccagctcttcccaggacaggggatcccgccaagggggccgcccccgccccggccctcccccgcccggccgcaccataaagcgcccggccgctgccgcggagcccagcagccagctccccagcaccgcacggcggggacgcgagcgcgcccccgacggcagcccggacgccgagcacgggtcacctgcggcgccggcccgggcgccgaccgaggttcaacgcacggcccggggacccccaggcggggccaacgccgccgtcgcccccggcctcgcggggagcaggaagagccaacatgctggccccgcgcggagccgccgtcctcctgctgcacctggtcctgcagcggtggctagcggcaggcgcccaggccaccccccagggtaagtgggttcgggtcgggcctgggagcgc

SEQ ID NO: 124716 - DNA, 30 bp, Homo sapiens; identical to SEQ ID NO: 94328
  misc_feature 1..30: note = chr5:79550635-79550665
  misc_feature 1..30: note = Hyper
  source 1..30: mol_type = genomic DNA

SEQ ID NO: 124717 - DNA, 34 bp, Homo sapiens; identical to SEQ ID NO: 94329
  misc_feature 1..34: note = chr5:79554316-79554350
  misc_feature 1..34: note = Hypo
  source 1..34: mol_type = genomic DNA

SEQ ID NO: 124718 - DNA, 16 bp, Homo sapiens
  misc_feature 1..16: note = chr5:79783240-79783256
  misc_feature 1..16: note = Hypo
  source 1..16: mol_type = genomic DNA
acagtctagctctatc

SEQ ID NO: 124719 - DNA, 30 bp, Homo sapiens; identical to SEQ ID NO: 94331
  misc_feature 1..30: note = chr5:79784399-79784429
  misc_feature 1..30: note = Hyper
  source 1..30: mol_type = genomic DNA

SEQ ID NO: 124720 - DNA, 835 bp, Homo sapiens
  misc_feature 1..835: note = chr5:79864827-79865662
  misc_feature 1..835: note = Hyper
  source 1..835: mol_type = genomic DNA
tgaggatgctggcagcgtctccacggtccccgccgacccctggaaccaggcgcgtttcctcagtttttcctgagagcaggaggaagcgagctcaaggcgctgtcggagaagggcaaaggaaggtgactggggcgacagctccagggcaccgatgggggcggggtgcgcgtttcgtcgcctcatctctgagccagggcaggcagctggcgggctaaggcgatcaccatccatgaaaacgggttctgcccacagccgctgcggagcggtccctgcgccgctcgcccgccggccggacgcggccctcccttgggaaatggtgcgtctgaggggcgcagccactgcccccatcccggagcaggcgcacctctgcacccggctctctgctaagggggtccggtatcctggtgccaaggctgtgcgcacctgagaagggcgggaaccggctgcccgcccctgtgtggctcctggaagcaggagctcctggaagctgcaaagggctccgcagtccccagcccgcccccagcgcccagccggcacctcctgctgcccagctgccgaggcacctgcggagacgcgcccaagtcagcccctccggagacgcgcccaagtcagcccctccgacccgcgcgctcttgcggcccagcgcgcgccgctcccgctgctgcgccgaccttcgcccatcaggccccccgccccgcatcctcctcgacaccccgcggccgggcagccctcgccggttcccgccgctcggcgaggctgagaaggaggcggaacccgcatccccgcggagtccaagccccagcggccgcaaaactggaaccgagaaccagtggga

SEQ ID NO: 124721 - DNA, 619 bp, Homo sapiens
  misc_feature 1..619: note = chr5:79865891-79866510
  misc_feature 1..619: note = Hyper
  source 1..619: mol_type = genomic DNA
tcgatgtcctcctcccggcagccgccactgcaagccaaagtttcccaagtgcagccggcagggacggcgcctcacactgacctgggacgcgctgtcgagttggcggcggcgctttcaaacctctctccggcactgcccgaccctctgtgcggccctagggcgccgtctgagctgagctgtggtcttcggctcctcggcgcctcgaatcgcagatctcggtagatgccgcccagtccccgccctgcttgcggaaagaggcgggcgactgccgcgaagcgctggagctgggacccggagcgcacacctcgccagacgcccgggcagcgaggcgcttccgctgggggtgacgcgtcggctccaggctctgcgcaggtgagggcggcaaggctcctctggacccaggggggccagcagctgctggaagctccgccttctgtccccgtaagtcccacccccgtcccccgcttcggccaccgcgcttcggccacggcgacttggccaacaacagcggcagcagggtctccccattgagggaagcacgcacccctacgtcacgggctttggctcctccagtccgtatccctcccctcagctcacatccacccgctggttcatgggt

SEQ ID NO: 124722 - DNA, 169 bp, Homo sapiens; identical to SEQ ID NO: 94335
  misc_feature 1..169: note = chr5:79911156-79911325
  misc_feature 1..169: note = Hypo
  source 1..169: mol_type = genomic DNA

SEQ ID NO: 124723 - DNA, 302 bp, Homo sapiens; identical to SEQ ID NO: 94336
  misc_feature 1..302: note = chr5:79947482-79947784
  misc_feature 1..302: note = Hypo
  source 1..302: mol_type = genomic DNA

SEQ ID NO: 124724 - DNA, 815 bp, Homo sapiens
  misc_feature 1..815: note = chr5:80255751-80256566
  misc_feature 1..815: note = Hyper
  source 1..815: mol_type = genomic DNA
tgtcatgagtgtgtgcgcgtgtgtttttgtgcatatgtgcgcgcattgtgtttgtgtgcatttgtgagtgtatttttgtgcgtctgagtgtgtgcattgtggatctgggtgaatgtactggtctgcgtgtgtgtgggtgtgcgtgtgtgtgtgcgcgcgttgtgcgcgagtgtgcgagcgcgtgtgagcgggtgtgtggtgcggccgggcgcctccacctccctgatccgccccatcccggcgggcgcccgagcagaggcagcggcccgggccggggcgggcgagggagggacgcgagccggggcaagcgggctgcgccaccgccggcgccgcgccgactttgccctttaaatcggtctccaagccgattacagctgagctcccacgtgacgttttaccttctgtctcccggagcgcgttgcccgaggacagtccttccccggctgccgccccagcccgccgcgggggctcggctcccgcaactttgggcgaagcggcggccggctcgggcgccctcgcggggccgcgctccacgcgggcgttgggggcttggggggctccgggggctcggccgggagggtggtggttagggcggagagcgtgcctcggccccagcccgcgcccctgccaccgcgcgccgcggcctcccgaaagcgggcggggtgccctgcgcgcggcgtggggaaagggggcgcccttcgccggccgggacctgagcggtcgcgccctcgagggagccagctgggccatggccgcgaggcaggggtgagaccggcggccacccgtgagccctccgcacccgcaccatgcagaag

SEQ ID NO: 124725 - DNA, 207 bp, Homo sapiens
  misc_feature 1..207: note = chr5:80256790-80256997
  misc_feature 1..207: note = Hyper
  source 1..207: mol_type = genomic DNA
gccacccagggccggcgccgggcagggaggcgtccgagacgcgctggacaagcaggtaccgcgcgccttctctccgcggtctcccagccttgatcgccgcactcccttgccgtcctaatccggggatcaggggtcgggggtcgtgaaagagtgcggggactatgctccgaaatccccccgcgtcaccagtggcgggacatctccacg

SEQ ID NO: 124726 - DNA, 591 bp, Homo sapiens
  misc_feature 1..591: note = chr5:80689592-80690183
  misc_feature 1..591: note = Hyper
  source 1..591: mol_type = genomic DNA
ggaatgaaggagtcccgagagccacacatttgggaaccaccggtctcggccatgcccagcgcgggcgcactgttgcaacacccctatccctggctgcgcagggttcagctctccgcaagtaccttcctcgccttcctaccccccccagcccccagccgccgccgctcccgcagccccggtcccgcgcctccccgcagccccggcgcccgcctacccgccaggcaggcggtggtgtcgatccacttgagcagctgccccgcgctcagctcgccgcgcgcagtggcgtgcgccggctggatggcttggctcatgaccacctcgccgggcgccggccgctccatggccagggcgagagcgctacgcctgcggcccccgacaccccaccatgcccgctccgcccgccccgccctccccgcccagctccagagggcactggcgccgcccgcccgggccgcgaacccctggccgccaggtggtgggagctgcgagtgagggggcccgcactgtcatcccaggactatcgcgagtgggggaaaaccagcgctctcgggtctcaggagaagtctgggaagtgcgcggggagggggctcc

SEQ ID NO: 124727 - DNA, 26 bp, Homo sapiens
  misc_feature 1..26: note = chr5:80887672-80887698
  misc_feature 1..26: note = Hypo
  source 1..26: mol_type = genomic DNA
aggagccaagatggccgaataggaac

SEQ ID NO: 124728 - DNA, 143 bp, Homo sapiens; identical to SEQ ID NO: 94345
  misc_feature 1..143: note = chr5:80895313-80895456
  misc_feature 1..143: note = Hypo
  source 1..143: mol_type = genomic DNA

SEQ ID NO: 124729 - DNA, 89 bp, Homo sapiens; identical to SEQ ID NO: 94346
  misc_feature 1..89: note = chr5:81075041-81075130
  misc_feature 1..89: note = Hyper
  source 1..89: mol_type = genomic DNA

SEQ ID NO: 124730 - DNA, 103 bp, Homo sapiens; identical to SEQ ID NO: 94347
  misc_feature 1..103: note = chr5:81266149-81266252
  misc_feature 1..103: note = Hypo
  source 1..103: mol_type = genomic DNA

SEQ ID NO: 124731 - DNA, 38 bp, Homo sapiens; identical to SEQ ID NO: 94348
  misc_feature 1..38: note = chr5:81266652-81266690
  misc_feature 1..38: note = Hypo
  source 1..38: mol_type = genomic DNA

SEQ ID NO: 124732 - DNA, 21 bp, Homo sapiens
  misc_feature 1..21: note = chr5:81575044-81575065
  misc_feature 1..21: note = Hypo
  source 1..21: mol_type = genomic DNA
ccaccgcgcctggccatttaa

SEQ ID NO: 124733 - DNA, 784 bp, Homo sapiens; identical to SEQ ID NO: 94351
  misc_feature 1..784: note = chr5:82767026-82767810
  misc_feature 1..784: note = Hyper
  source 1..784: mol_type = genomic DNA

SEQ ID NO: 124734 - DNA, 1152 bp, Homo sapiens; identical to SEQ ID NO: 29742
  misc_feature 1..1152: note = chr5:82768217-82769369
  misc_feature 1..1152: note = Hyper
  source 1..1152: mol_type = genomic DNA

SEQ ID NO: 124735 - DNA, 408 bp, Homo sapiens; identical to SEQ ID NO: 94353
  misc_feature 1..408: note = chr5:82769910-82770318
  misc_feature 1..408: note = Hyper
  source 1..408: mol_type = genomic DNA

SEQ ID NO: 124736 - DNA, 49 bp, Homo sapiens; identical to SEQ ID NO: 94354
  misc_feature 1..49: note = chr5:82770563-82770612
  misc_feature 1..49: note = Hyper
  source 1..49: mol_type = genomic DNA

SEQ ID NO: 124737 - DNA, 172 bp, Homo sapiens; identical to SEQ ID NO: 94355
  misc_feature 1..172: note = chr5:83017828-83018000
  misc_feature 1..172: note = Hyper
  source 1..172: mol_type = genomic DNA

SEQ ID NO: 124738 - DNA, 30 bp, Homo sapiens; identical to SEQ ID NO: 94356
  misc_feature 1..30: note = chr5:83527381-83527411
  misc_feature 1..30: note = Hypo
  source 1..30: mol_type = genomic DNA

SEQ ID NO: 124739 - DNA, 94 bp, Homo sapiens; identical to SEQ ID NO: 94357
  misc_feature 1..94: note = chr5:83678217-83678311
  misc_feature 1..94: note = Hyper
  source 1..94: mol_type = genomic DNA

SEQ ID NO: 124740 - DNA, 265 bp, Homo sapiens; identical to SEQ ID NO: 94358
  misc_feature 1..265: note = chr5:83678989-83679254
  misc_feature 1..265: note = Hyper
  source 1..265: mol_type = genomic DNA

SEQ ID NO: 124741 - DNA, 800 bp, Homo sapiens
  misc_feature 1..800: note = chr5:83679569-83680369
  misc_feature 1..800: note = Hyper
  source 1..800: mol_type = genomic DNA
cctctccacctcacccgcggccaaaacgcccagcgccgggtctgggtttgcgaacggctcagcccaggccctgcgccagagcaccgcacccgggggcggacggccctgcagctccccagcctcttcccgcatcaactagctgacgcccgggcgcactggcttcccccgctcccgcccgcacgaaagccctgcccgacgtctgcagtcagcatcgcccgcactgcctagggagggtttgcgccgagacccagtggccgagtgagccacagagtcgctggtcctggggacgctgtcttctaccgctccccaccgtcctcctctttcctgtatctcaccccggtaccccgcacccttctccccgctcggccccgcgcactctgctcagactttacaagcactttctcggggcacccaggactcgacgcctcctccgcgccgccagcggcgctcgccacccttggcacgccggagggaccgcctccggccccctgcgcggcgtttctcaggggactcccagcccatccctcacccagctgtccgggtcccgacgccttacctttgccgaactgggggacaccgaggctgagcccgaccaagagccagacggctaccgagcgcttcatgatcccgtctcccggacgtgaccccggctggtcaggggtcgtcgcggagggcagtgtagccgaggtggcagcgcagggcagcagcagactccgcccctactaaagaattcaagaagacgttctctttcctcagcgctttgttaaacaaattcttggagagggcgagagtggtgacta

SEQ ID NO: 124742 - DNA, 80 bp, Homo sapiens
  misc_feature 1..80: note = chr5:83680671-83680751
  misc_feature 1..80: note = Hyper
  source 1..80: mol_type = genomic DNA
gtgtacaaacagaggcggcgtgcgtgtgagtctgagcctggcaggcgcgctccccactcccccggcgcccgcccgccctc

SEQ ID NO: 124743 - DNA, 30 bp, Homo sapiens; identical to SEQ ID NO: 94362
  misc_feature 1..30: note = chr5:84126401-84126431
  misc_feature 1..30: note = Hypo
  source 1..30: mol_type = genomic DNA

SEQ ID NO: 124744 - DNA, 32 bp, Homo sapiens; identical to SEQ ID NO: 94364
  misc_feature 1..32: note = chr5:86308932-86308964
  misc_feature 1..32: note = Hypo
  source 1..32: mol_type = genomic DNA

SEQ ID NO: 124745 - DNA, 30 bp, Homo sapiens; identical to SEQ ID NO: 94365
  misc_feature 1..30: note = chr5:86795866-86795896
  misc_feature 1..30: note = Hypo
  source 1..30: mol_type = genomic DNA

SEQ ID NO: 124746 - DNA, 225 bp, Homo sapiens; identical to SEQ ID NO: 94366
  misc_feature 1..225: note = chr5:86837505-86837730
  misc_feature 1..225: note = Hypo
  source 1..225: mol_type = genomic DNA

SEQ ID NO: 124747 - DNA, 175 bp, Homo sapiens; identical to SEQ ID NO: 94367
  misc_feature 1..175: note = chr5:87436594-87436769
  misc_feature 1..175: note = Hyper
  source 1..175: mol_type = genomic DNA

SEQ ID NO: 124748 - DNA, 30 bp, Homo sapiens; identical to SEQ ID NO: 29749
  misc_feature 1..30: note = chr5:87955350-87955380
  misc_feature 1..30: note = Hyper
  source 1..30: mol_type = genomic DNA

SEQ ID NO: 124749 - DNA, 338 bp, Homo sapiens
  misc_feature 1..338: note = chr5:87955602-87955940
  misc_feature 1..338: note = Hyper
  source 1..338: mol_type = genomic DNA
ttggccagtgcccttcggtgtcactgaagctcagcccgcggacggcggtgtgtcagtgtgcaccgggaggcctgggcctcagtccctgggctcgtgcctacgcaacagcaggaccgcccgcggcctcccaggaccagtgaccgtcacccgcagtaaggatcggggcggctccgccagtttcggccctctttccaagacctctttccaaggcgctctttcctagcctcacccgagggccgcagagccggacctgtgccgggcgagttggatttagcccagttagagttaagatggtatcattagctgcgcacagcgtgacttcccgctaatcctctctg

SEQ ID NO: 124750 - DNA, 1042 bp, Homo sapiens
  misc_feature 1..1042: note = chr5:87956158-87957200
  misc_feature 1..1042: note = Hyper
  source 1..1042: mol_type = genomic DNA
gcccagagtggcaagcgctcaccaacgccggccaccgagcaaaacttccccgcccccgccccccacccagcttccccgcagggagaccctttccgttagcagcttttcactaagttaataacggtgtgtgtgtggtggtggcggggaggggggatttgggggttacacaatatctatatcaatgatattgatcacgtccagggaagaagcctgggcaaaactagagacaccgagtgtcagcaaaagaaagcttcttaaccacaagttgcgtgccgcctgaggaaggtgccctgtggcagggggtggccgctgggagatgcctgcctctaaccgacgtccaggcgtgactaaacctcgacgccacccccattcacaagctcaactcagggattcccaagcaaccgcagaccggaggtggcgcagaggcagtgaccgaggtcgctgattaggggccgagaggctggcaaataataattttaaaaaaaaaaaaaaccggaatagccttcgcggacgcagctcagcgtgccaggcaaaggacagtctgacgacccgcccctgccgagccccgcagcgcggcgccggtgtccagcagcctccaaggcgccgagcgcgggcacgggaacttgagctagcgcaaacttgggcggcctcccagcctgctacccgggccgcagcgcgcccccggcctcccagtcgcgcgccaacccgggagcgcgcgcgccggcgcaccagctccatcagctagaggagcccgtctcccgggaaacaccaatcagacgcccgctttcaggcgagggccgcgagccgcagcagctgcaggaggactcgggcagttggcggtcaccgggaggcgtcgtcctgccccgcggcgggccagccgccttcgctgctgccactgcctagcctaaccgcatctgcagccagtcacagagtcggctgtctcctctttgcaccgcccacgccaagtaccttgcaaggcggctgctaagcctggctaattttagatctccagaatgcgctatgcccgcgctcaactaaaacc

SEQ ID NO: 124751 - DNA, 287 bp, Homo sapiens; identical to SEQ ID NO: 94373
  misc_feature 1..287: note = chr5:87961738-87962025
  misc_feature 1..287: note = Hyper
  source 1..287: mol_type = genomic DNA

SEQ ID NO: 124752 - DNA, 302 bp, Homo sapiens; identical to SEQ ID NO: 94374
  misc_feature 1..302: note = chr5:87962615-87962917
  misc_feature 1..302: note = Hyper
  source 1..302: mol_type = genomic DNA

SEQ ID NO: 124753 - DNA, 55 bp, Homo sapiens; identical to SEQ ID NO: 29755
  misc_feature 1..55: note = chr5:87963456-87963511
  misc_feature 1..55: note = Hyper
  source 1..55: mol_type = genomic DNA

SEQ ID NO: 124754 - DNA, 506 bp, Homo sapiens
  misc_feature 1..506: note = chr5:87967713-87968219
  misc_feature 1..506: note = Hyper
  source 1..506: mol_type = genomic DNA
agcgccctaattaccggtgccaaggtggagaaaggagggtggtagacagaggtggacaccaagaaagggaggaaacggaacccgactctgcggtgctgggcccaaggcagccacagctccaaaggggcccccggccgtggccgtgacttgacagagcctccggtctaacttctgatcaattccactgctctcctgacccctcaagacagtcccccattcaagcaccgcgggtacatttgcaagataaaacgccgcagacactaatgcaaatacattgcccgagttcccatcaccctgggttcctgcagataattccaggccacagaaaggagttcttgccttcctcagccgggtctagactctaagcaaaccgcaaagacctagctccgtttggataccagaagcgtcttaagctgaaccgctccaagtaccaataactaaccatgatggttgcatcttgatgaatctgaacttgggataaccctgtaaagcggcctctcacctcc

SEQ ID NO: 124755 - DNA, 503 bp, Homo sapiens
  misc_feature 1..503: note = chr5:87968488-87968991
  misc_feature 1..503: note = Hyper
  source 1..503: mol_type = genomic DNA
ttcccttttccaacgcgaagatttcctggcatctctctgcgattgggggtcaagccgctggataattaacagtactggctaagaaaactcacgagatcaacaggtttaacatccgaggcacacaatcaattagctgaagcaaagccccggactggccctcggagcggcccgcagcgggactctgcgggcaccggctagcgggcgaggtgaggagtgcgggcgcggggccgcggcgggcactgctggcctcgcgccgcgggcgagctgcagcctgagggccgccacgatactcacttgatctccctgcgccaggcaatgctgccccccaaatccagctgggcaggaaccgaggcgccggctgaaagacaagatccaaagtcacagcacggccgcagcacacaaacaggcttctttcggcgtctccaaaaaaaaaaaaaaaaatgtttttctcatcattcctctcccctgctcaacacatttaaaactgccgctcaattccacat

SEQ ID NO: 124756 - DNA, 877 bp, Homo sapiens
  misc_feature 1..877: note = chr5:87970041-87970918
  misc_feature 1..877: note = Hyper
  source 1..877: mol_type = genomic DNA
gaagggtgggggcttcgaggggaaggtgggcttcctgcaacacaagcggagaggctgtcaggggtgtgggcacgggggtgcggggaggcggtgcaggaatccgtcccgccgagtgccgtcggcccctgtgggcctgtttgcgcgcctggggctggccgcattctgggcgcgggtgtctgcgtgccggggtggtagttccgagcctgcgcgcgtgcgaccgggtacgggagggggaagagtgccgtaaaaattcagacgagtggcccgtatgtaaatgcagcccgcggggagcagggaggcggtaatgacagccgctggcgctcagccccgccggcggcccctagctttcccgccaagtgcagccggaggacagacagccatgcgtgtccttggcgggagagcccccacccgccgcgcgcgcccgacccccgcgcacacgcacacactcccctcgcaggcgtggggcccaatggccacgaacatgtcaggaaaacaaagctggggctgcgaggtggaacgatgaaacggcacacttggcggccgagggcagagcggagaagtcgccaccacagccaccggcgcccctttcttgcctgctcgtagatctgccctccggcccagaagaggccgaggaccatttcttagctgccccagaggagggggcgagcagaggagggggcggatgtgcacagggaggtgccagcggtccggtgcgcgggcacgcacacgccggcgcgcagggctgccgcgggcggaaggaggggaatgacaaggcctcggccgcgtctcggagaggcactacctccgcgctgaggccgctgagtttcaagtgcaaaacaccaggccaaatccggcaaggcggcggctacagaatggc

SEQ ID NO: 124757 - DNA, 624 bp, Homo sapiens; identical to SEQ ID NO: 94381
  misc_feature 1..624: note = chr5:87971517-87972141
  misc_feature 1..624: note = Hyper
  source 1..624: mol_type = genomic DNA

SEQ ID NO: 124758 - DNA, 30 bp, Homo sapiens; identical to SEQ ID NO: 94382
  misc_feature 1..30: note = chr5:87973581-87973611
  misc_feature 1..30: note = Hyper
  source 1..30: mol_type = genomic DNA

SEQ ID NO: 124759 - DNA, 1076 bp, Homo sapiens; identical to SEQ ID NO: 94383
  misc_feature 1..1076: note = chr5:87973988-87975064
  misc_feature 1..1076: note = Hyper
  source 1..1076: mol_type = genomic DNA

SEQ ID NO: 124760 - DNA, 461 bp, Homo sapiens; identical to SEQ ID NO: 94384
  misc_feature 1..461: note = chr5:87976202-87976663
  misc_feature 1..461: note = Hyper
  source 1..461: mol_type = genomic DNA

SEQ ID NO: 124761 - DNA, 87 bp, Homo sapiens; identical to SEQ ID NO: 94385
  misc_feature 1..87: note = chr5:87979692-87979779
  misc_feature 1..87: note = Hyper
  source 1..87: mol_type = genomic DNA

SEQ ID NO: 124762 - DNA, 86 bp, Homo sapiens; identical to SEQ ID NO: 94386
  misc_feature 1..86: note = chr5:87979899-87979985
  misc_feature 1..86: note = Hyper
  source 1..86: mol_type = genomic DNA

SEQ ID NO: 124763 - DNA, 164 bp, Homo sapiens; identical to SEQ ID NO: 94387
  misc_feature 1..164: note = chr5:87980397-87980561
  misc_feature 1..164: note = Hyper
  source 1..164: mol_type = genomic DNA

SEQ ID NO: 124764 - DNA, 704 bp, Homo sapiens; identical to SEQ ID NO: 94388
  misc_feature 1..704: note = chr5:87980621-87981325
  misc_feature 1..704: note = Hyper
  source 1..704: mol_type = genomic DNA

SEQ ID NO: 124765 - DNA, 30 bp, Homo sapiens; identical to SEQ ID NO: 29769
  misc_feature 1..30: note = chr5:87983365-87983395
  misc_feature 1..30: note = Hyper
  source 1..30: mol_type = genomic DNA

SEQ ID NO: 124766 - DNA, 30 bp, Homo sapiens; identical to SEQ ID NO: 29770
  misc_feature 1..30: note = chr5:87984984-87985014
  misc_feature 1..30: note = Hyper
  source 1..30: mol_type = genomic DNA

SEQ ID NO: 124767 - DNA, 293 bp, Homo sapiens; identical to SEQ ID NO: 94391
  misc_feature 1..293: note = chr5:87985348-87985641
  misc_feature 1..293: note = Hyper
  source 1..293: mol_type = genomic DNA

SEQ ID NO: 124768 - DNA, 157 bp, Homo sapiens; identical to SEQ ID NO: 94392
  misc_feature 1..157: note = chr5:87985895-87986052
  misc_feature 1..157: note = Hyper
  source 1..157: mol_type = genomic DNA

SEQ ID NO: 124769 - DNA, 83 bp, Homo sapiens; identical to SEQ ID NO: 94393
  misc_feature 1..83: note = chr5:87986310-87986393
  misc_feature 1..83: note = Hyper
  source 1..83: mol_type = genomic DNA

SEQ ID NO: 124770 - DNA, 30 bp, Homo sapiens; identical to SEQ ID NO: 94394
  misc_feature 1..30: note = chr5:87987135-87987165
  misc_feature 1..30: note = Hyper
  source 1..30: mol_type = genomic DNA

SEQ ID NO: 124771 - DNA, 499 bp, Homo sapiens; identical to SEQ ID NO: 94395
  misc_feature 1..499: note = chr5:87988152-87988651
  misc_feature 1..499: note = Hyper
  source 1..499: mol_type = genomic DNA

SEQ ID NO: 124772 - DNA, 144 bp, Homo sapiens; identical to SEQ ID NO: 94396
  misc_feature 1..144: note = chr5:87990308-87990452
  misc_feature 1..144: note = Hyper
  source 1..144: mol_type = genomic DNA

SEQ ID NO: 124773 - DNA, 30 bp, Homo sapiens; identical to SEQ ID NO: 94397
  misc_feature 1..30: note = chr5:87991044-87991074
  misc_feature 1..30: note = Hyper
  source 1..30: mol_type = genomic DNA

SEQ ID NO: 124774 - DNA, 30 bp, Homo sapiens; identical to SEQ ID NO: 29777
  misc_feature 1..30: note = chr5:87991432-87991462
  misc_feature 1..30: note = Hyper
  source 1..30: mol_type = genomic DNA

SEQ ID NO: 124775 - DNA, 30 bp, Homo sapiens; identical to SEQ ID NO: 94399
  misc_feature 1..30: note = chr5:88015167-88015197
  misc_feature 1..30: note = Hypo
  source 1..30: mol_type = genomic DNA

SEQ ID NO: 124776 - DNA, 259 bp, Homo sapiens; identical to SEQ ID NO: 94400
  misc_feature 1..259: note = chr5:88178852-88179111
  misc_feature 1..259: note = Hyper
  source 1..259: mol_type = genomic DNA

SEQ ID NO: 124777 - DNA, 258 bp, Homo sapiens; identical to SEQ ID NO: 94401
  misc_feature 1..258: note = chr5:88179171-88179429
  misc_feature 1..258: note = Hyper
  source 1..258: mol_type = genomic DNA

SEQ ID NO: 124778 - DNA, 495 bp, Homo sapiens; identical to SEQ ID NO: 94402
  misc_feature 1..495: note = chr5:88179851-88180346
  misc_feature 1..495: note = Hyper
  source 1..495: mol_type = genomic DNA

SEQ ID NO: 124779 - DNA, 1148 bp, Homo sapiens
  misc_feature 1..1148: note = chr5:88184853-88186001
  misc_feature 1..1148: note = Hyper
  source 1..1148: mol_type = genomic DNA
taaaaaatctttacccggggttgtggtggaagtggggattaaaaatctcgtcctgcgttttggtgcccacttctttgtttggaaagcagagcgctgggactcaatccggacggccctcaaagacccagacgagggacgcctctagtttgagcaactcactccgctgagttattgattgcaggcagcaacaatccctccggttgatttgtgtgaaaagtgaatccgctctggctgggcgttcagcagaggcgcaacagctgcaacgccatccaattattgccgatcctcccctccaacactgctctcatcacctatatactcttctctctgcccgtctctgcttccccccccttccccccccccttttctcccggccgacggagctgaaggggcgggggttccttccttggagtgtttctagagctcggaggctgctggtagggggtgagtgcgccacgtgcgtgcgccacgggcgagcaggaggcaggctctgggccctcctggggacctgctggacctgctggacctgggtgcgacgagtgggcggccacgctggtttggcgcggggaaggaagggggtgtgccgacttgtatttagttgggggttgtggaagtcacggctgggggaaaagcgtccggtggtttgttggtaaagagggtgcgtgatgggctctggggaatggaggagggcgcaacggctgtgggtggactgtggaaacgggcggtggcagtgccggggtagttgtcctgctggtctggttttgggatcctgggctggagaaatgcgatccaaaagagctcgggatgggctcagagcgacccacgaaaataccaggggccaagtaaaatgaacccaccctttaacagtgcacaaagcgctggcacacggtccacgtctggtgacgcaggctgcccgaagcgctccaaccattttgcaaacctgggagagcaagaggggctctgcaggtctagccgccgcccctgtcccactctggccagccggagtttttcacctgacagaccaataggaaagaacacgggccccaaactggattttatagtctgagctctcagcatctaaggaattatatttcaaaaaacaaaagccaactcatagctctattaagctaacgcgtgtgcgagttttg

SEQ ID NO: 124780 - DNA, 26 bp, Homo sapiens
  misc_feature 1..26: note = chr5:88371468-88371494
  misc_feature 1..26: note = Hypo
  source 1..26: mol_type = genomic DNA
aatcttgcttaggggcggatctcctg

SEQ ID NO: 124781 - DNA, 32 bp, Homo sapiens; identical to SEQ ID NO: 94406
  misc_feature 1..32: note = chr5:88391487-88391519
  misc_feature 1..32: note = Hypo
  source 1..32: mol_type = genomic DNA

SEQ ID NO: 124782 - DNA, 30 bp, Homo sapiens; identical to SEQ ID NO: 94407
  misc_feature 1..30: note = chr5:88427549-88427579
  misc_feature 1..30: note = Hypo
  source 1..30: mol_type = genomic DNA

SEQ ID NO: 124783 - DNA, 30 bp, Homo sapiens; identical to SEQ ID NO: 94408
  misc_feature 1..30: note = chr5:89073758-89073788
  misc_feature 1..30: note = Hypo
  source 1..30: mol_type = genomic DNA

SEQ ID NO: 124784 - DNA, 26 bp, Homo sapiens
  misc_feature 1..26: note = chr5:89504166-89504192
  misc_feature 1..26: note = Hypo
  source 1..26: mol_type = genomic DNA
tggcagaataggaaccgctccaatct

SEQ ID NO: 124785 - DNA, 30 bp, Homo sapiens; identical to SEQ ID NO: 94411
  misc_feature 1..30: note = chr5:89854111-89854141
  misc_feature 1..30: note = Hyper
  source 1..30: mol_type = genomic DNA

SEQ ID NO: 124786 - DNA, 446 bp, Homo sapiens; identical to SEQ ID NO: 29782
  misc_feature 1..446: note = chr5:89854523-89854969
  misc_feature 1..446: note = Hyper
  source 1..446: mol_type = genomic DNA

SEQ ID NO: 124787 - DNA, 37 bp, Homo sapiens; identical to SEQ ID NO: 94417
  misc_feature 1..37: note = chr5:92906137-92906174
  misc_feature 1..37: note = Hyper
  source 1..37: mol_type = genomic DNA

SEQ ID NO: 124788 - DNA, 196 bp, Homo sapiens
  misc_feature 1..196: note = chr5:92906518-92906714
  misc_feature 1..196: note = Hyper
  source 1..196: mol_type = genomic DNA
ccgcgcgcaaggctccgcggccggatatgggcctagcttccgggatccgctccctgcggggccgcgcttagggtcggagttcgctagtccagggaaaggggtgggaggggccctcggaggggcccctacaagggatcccagtccgcagaattaaaaattcgttcgcaagggagcgcccttccggggtcagggtcgt

SEQ ID NO: 124789 - DNA, 86 bp, Homo sapiens
  misc_feature 1..86: note = chr5:92915042-92915128
  misc_feature 1..86: note = Hyper
  source 1..86: mol_type = genomic DNA
ccttccggaggagcccgcggcttcgcctgaggcctcgcgggcccaacttctccccaccgctagggtcacgccgggtcccaggggcc

SEQ ID NO: 124790 - DNA, 150 bp, Homo sapiens; identical to SEQ ID NO: 94420
  misc_feature 1..150: note = chr5:92915445-92915595
  misc_feature 1..150: note = Hyper
  source 1..150: mol_type = genomic DNA

SEQ ID NO: 124791 - DNA, 328 bp, Homo sapiens; identical to SEQ ID NO: 29785
  misc_feature 1..328: note = chr5:92915837-92916165
  misc_feature 1..328: note = Hyper
  source 1..328: mol_type = genomic DNA

SEQ ID NO: 124792 - DNA, 30 bp, Homo sapiens; identical to SEQ ID NO: 94422
  misc_feature 1..30: note = chr5:92921022-92921052
  misc_feature 1..30: note = Hyper
  source 1..30: mol_type = genomic DNA

SEQ ID NO: 124793 - DNA, 427 bp, Homo sapiens
  misc_feature 1..427: note = chr5:92939780-92940207
  misc_feature 1..427: note = Hyper
  source 1..427: mol_type = genomic DNA
ggtgtttgggggctgcgtggtgagccgaggcaaagccagggtaccccgatcgtcttccgggcgcatccaccatgcggcaccgccccagccacggcggccgcgcgtggagacccgggggcttaacaaagggctccgcgggggcacgggggggcgcggccacgtgacaggcccgagcgcgacgtcgctgtccagccgcggggaggggcggccagcccggggggccgtggggcttcttgacatagaacgtccgggcctcgggctggccgcgccgggccgcgctccgccgggatgagaagtacttgtctggctccgcgctggagaagccgcacctctcatctctccggctcttacttgaaaaagcacttggaagaaactgtgtgtgcgctgggagggccgcggggtgggccggggccggctgcgaggctga

SEQ ID NO: 124794 - DNA, 30 bp, Homo sapiens
  misc_feature 1..30: note = chr5:92946622-92946652
  misc_feature 1..30: note = Hyper
  source 1..30: mol_type = genomic DNA
ctagtctagaatattcgagtcttcaagtca

SEQ ID NO: 124795 - DNA, 43 bp, Homo sapiens; identical to SEQ ID NO: 94425
  misc_feature 1..43: note = chr5:92948358-92948401
  misc_feature 1..43: note = Hyper
  source 1..43: mol_type = genomic DNA

SEQ ID NO: 124796 - DNA, 805 bp, Homo sapiens; identical to SEQ ID NO: 94427
  misc_feature 1..805: note = chr5:94620329-94621134
  misc_feature 1..805: note = Hyper
  source 1..805: mol_type = genomic DNA

SEQ ID NO: 124797 - DNA, 1724 bp, Homo sapiens; identical to SEQ ID NO: 94429
  misc_feature 1..1724: note = chr5:94955559-94957283
  misc_feature 1..1724: note = Hyper
  source 1..1724: mol_type = genomic DNA

SEQ ID NO: 124798 - DNA, 90 bp, Homo sapiens; identical to SEQ ID NO: 40573
  misc_feature 1..90: note = chr5:94982142-94982232
  misc_feature 1..90: note = Hypo
  source 1..90: mol_type = genomic DNA

SEQ ID NO: 124799 - DNA, 80 bp, Homo sapiens; identical to SEQ ID NO: 94431
  misc_feature 1..80: note = chr5:95067652-95067732
  misc_feature 1..80: note = Hyper
  source 1..80: mol_type = genomic DNA

SEQ ID NO: 124800 - DNA, 21 bp, Homo sapiens
  misc_feature 1..21: note = chr5:95117541-95117562
  misc_feature 1..21: note = Hypo
  source 1..21: mol_type = genomic DNA
agactccgtctcaaaaaaaga

SEQ ID NO: 124801 - DNA, 98 bp, Homo sapiens; identical to SEQ ID NO: 94436
  misc_feature 1..98: note = chr5:95551329-95551427
  misc_feature 1..98: note = Hypo
  source 1..98: mol_type = genomic DNA

SEQ ID NO: 124802 - DNA, 30 bp, Homo sapiens; identical to SEQ ID NO: 94437
  misc_feature 1..30: note = chr5:95767930-95767960
  misc_feature 1..30: note = Hyper
  source 1..30: mol_type = genomic DNA

SEQ ID NO: 124803 - DNA, 161 bp, Homo sapiens; identical to SEQ ID NO: 94438
  misc_feature 1..161: note = chr5:95768166-95768327
  misc_feature 1..161: note = Hyper
  source 1..161: mol_type = genomic DNA

SEQ ID NO: 124804 - DNA, 200 bp, Homo sapiens; identical to SEQ ID NO: 94439
  misc_feature 1..200: note = chr5:95768893-95769093
  misc_feature 1..200: note = Hyper
  source 1..200: mol_type = genomic DNA

SEQ ID NO: 124805 - DNA, 116 bp, Homo sapiens; identical to SEQ ID NO: 94440
  misc_feature 1..116: note = chr5:95769953-95770069
  misc_feature 1..116: note = Hyper
  source 1..116: mol_type = genomic DNA

SEQ ID NO: 124806 - DNA, 43 bp, Homo sapiens; identical to SEQ ID NO: 94441
  misc_feature 1..43: note = chr5:96038372-96038415
  misc_feature 1..43: note = Hyper
  source 1..43: mol_type = genomic DNA

SEQ ID NO: 124807 - DNA, 45 bp, Homo sapiens; identical to SEQ ID NO: 94442
  misc_feature 1..45: note = chr5:98104846-98104891
  misc_feature 1..45: note = Hyper
  source 1..45: mol_type = genomic DNA

SEQ ID NO: 124808 - DNA, 110 bp, Homo sapiens; identical to SEQ ID NO: 94443
  misc_feature 1..110: note = chr5:98200994-98201104
  misc_feature 1..110: note = Hypo
  source 1..110: mol_type = genomic DNA

SEQ ID NO: 124809 - DNA, 30 bp, Homo sapiens; identical to SEQ ID NO: 94444
  misc_feature 1..30: note = chr5:99383200-99383230
  misc_feature 1..30: note = Hypo
  source 1..30: mol_type = genomic DNA

SEQ ID NO: 124810 - DNA, 150 bp, Homo sapiens; identical to SEQ ID NO: 94445
  misc_feature 1..150: note = chr5:99389805-99389955
  misc_feature 1..150: note = Hypo
  source 1..150: mol_type = genomic DNA

SEQ ID NO: 124811 - DNA, 1730 bp, Homo sapiens; identical to SEQ ID NO: 92690
  misc_feature 1..1730: note = chr5:100236150-100237880
  misc_feature 1..1730: note = Hyper
  source 1..1730: mol_type = genomic DNA

SEQ ID NO: 124812 - DNA, 1441 bp, Homo sapiens
  misc_feature 1..1441: note = chr5:100238283-100239724
  misc_feature 1..1441: note = Hyper
  source 1..1441: mol_type = genomic DNA
tgacttctcctttggcgagagagcacccagggccaacacaactgtcaccacaaccacacagagcaagttgaactcatactgggaacagcttagagaagcacgcacatctcaacaacagcctttgttatttaattcatgacactaaccacgcgcaagctcaaacaaacacacatgctatcctaaccatcactctaccctctatattcacatttcatttatggcttgactttttgtcatatcctgaaatgaagctttgcatttacccgatgagttgcgtctcctggtgctcctcagttcttgctatttcttttgtcttataaaagatcaggagcagacttattgtgcagatcgtccacctcttcctaatggagcgcatcttgggtgcccgagaaagtcctggttgccccagctcccgcaccttctcttgatataaaggctccgttttggggagatagtcgcgggggtgaaatctgtaaaatgcgaggagagcttggagccgggatcccgggatcagatcactggggtcttctgtggccgagctccctctggtcctcgaacgctgcccagcgacctctcgccctgtttgcgccagctctgccagggtcgctccgcgccgcctccctggggctcaggtttcttttcagatgagacaccttgtgcattggaggtggcggcagcttctgcagctgggttcgggggcgtcactggcccttccctcttgctaggagataaacgctgcgcaaagccaatcaccaggctgagggggcggaggctgcttggagagtaacgtccccggctctgcctgctctgtgccgggagaggaagctcacagtgctacgcgcctgcgagctcgcgcacatacacatatacatacatacacacatacatacatatgcacacacacgtacacgcagaatcacacacactctcctgggacatcaaagcatcagctctctggacctgggagctccaagatagtctatccgcatctaggtgagagggcacctcgcctggggacagattacaaaagcgtcccgccagaggaatgcttcaggtagagctaggggtggattgcaagaagagtaccttctttcaatcgcttttgctaaacacacaccctcacacgcaaaaacacgccctccaaggtggagtgaaacggggtgcgggggtggggacggcggtggaaggaagaagacttttattactcaatctggaaagtgcaaatacacacatgaacctgttagccgatgggcccactctgcatgggtggtggacgacgaccctggctcaggattctgcaggaaacaagtgatgatagaggtgtcattaggaactttatggatatttatgcgcctccctttcattgccatttggaaactcctcacgcagaagtcaaggaaactccaatcccacttaaacttcattgcggagaaacagagtt

SEQ ID NO: 124813 - DNA, 221 bp, Homo sapiens
  misc_feature 1..221: note = chr5:100240068-100240289
  misc_feature 1..221: note = Hyper
  source 1..221: mol_type = genomic DNA
tgttggctggtaggtcgggaggcacctctagcatgagacagtgtctggaagccaggatttccctcatctatatgcgccggtccccagctccctggtcgccagggtttctctccagttgaattccgtgttccttcaggttgaacagtagcttcagcggtttttcacgctcagaaatgatgaggcccaattccaatcttccctcccgccggaagtaagaaggg

SEQ ID NO: 124814 - DNA, 208 bp, Homo sapiens; identical to SEQ ID NO: 92701
  misc_feature 1..208: note = chr5:101631427-101631635
  misc_feature 1..208: note = Hyper
  source 1..208: mol_type = genomic DNA

SEQ ID NO: 124815 - DNA, 40 bp, Homo sapiens; identical to SEQ ID NO: 92702
  misc_feature 1..40: note = chr5:101632034-101632074
  misc_feature 1..40: note = Hyper
  source 1..40: mol_type = genomic DNA

SEQ ID NO: 124816 - DNA, 35 bp, Homo sapiens; identical to SEQ ID NO: 92703
  misc_feature 1..35: note = chr5:102048048-102048083
  misc_feature 1..35: note = Hypo
  source 1..35: mol_type = genomic DNA

SEQ ID NO: 124817 - DNA, 30 bp, Homo sapiens; identical to SEQ ID NO: 92704
  misc_feature 1..30: note = chr5:102090335-102090365
  misc_feature 1..30: note = Hyper
  source 1..30: mol_type = genomic DNA

SEQ ID NO: 124818 - DNA, 514 bp, Homo sapiens; identical to SEQ ID NO: 92733
  misc_feature 1..514: note = chr5:107005171-107005685
  misc_feature 1..514: note = Hyper
  source 1..514: mol_type = genomic DNA

SEQ ID NO: 124819 - DNA, 277 bp, Homo sapiens; identical to SEQ ID NO: 92734
  misc_feature 1..277: note = chr5:107005983-107006260
  misc_feature 1..277: note = Hyper
  source 1..277: mol_type = genomic DNA

SEQ ID NO: 124820 - DNA, 718 bp, Homo sapiens; identical to SEQ ID NO: 92735
  misc_feature 1..718: note = chr5:107006709-107007427
  misc_feature 1..718: note = Hyper
  source 1..718: mol_type = genomic DNA

SEQ ID NO: 124821 - DNA, 179 bp, Homo sapiens; identical to SEQ ID NO: 92737
  misc_feature 1..179: note = chr5:107840292-107840471
  misc_feature 1..179: note = Hypo
  source 1..179: mol_type = genomic DNA

SEQ ID NO: 124822 - DNA, 197 bp, Homo sapiens; identical to SEQ ID NO: 92744
  misc_feature 1..197: note = chr5:110022402-110022599
  misc_feature 1..197: note = Hypo
  source 1..197: mol_type = genomic DNA

SEQ ID NO: 124823 - DNA, 777 bp, Homo sapiens; identical to SEQ ID NO: 92745
  misc_feature 1..777: note = chr5:110408656-110409433
  misc_feature 1..777: note = Hyper
  source 1..777: mol_type = genomic DNA

SEQ ID NO: 124824 - DNA, 1123 bp, Homo sapiens
  misc_feature 1..1123: note = chr5:110559554-110560677
  misc_feature 1..1123: note = Hyper
  source 1..1123: mol_type = genomic DNA
taggtgggagggactcgccacggagacgcgctcaaggagggatgagttgcgccaccaccacctaggtccctctctcgctatccggcggggccgcccggacccaggtgctgccagggtacgcctggcgcccgccatcccagagcagcgtcccgctgcgcacggtctccctccagctccggtccccgcgggagggcgcgtgggatgatgcgcgggtccttgtgccttccccaagctccagcatccggagccgccctagccggcaccgcggcagccacagcctgggagagagaaaggaaagagggagggcggcgggaaaggctcggcgcgggaggagggcgggtgaggagggaaggagcgagggggagggagcctctctcctcagcggtgcagctagtctccctccagcgggcggcgactccgggttccccctcgcgccctctcgcagaggctcgcccccttccccgcccaccgtccctgcgagcgcgggcggcggcggtgggcgtgtgcgcgcgtgaaggacgccgcctctctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggtaaggcgcgggctccggctggggaagcccgcggcgtgcactgggggttgtccctctcgcagcgacggctcggagggtgcgggagcctgccttcgtgcccttcgatttctccctacctagttagtgtcttgagagagagctaaccttcattcaggtgcggctcgagtccttcccaccccaccagagcgcctaggccggtgcagctgtaggatcagcccgactccctcccaccttccctccttctcgcaggctgccacttcccttgggtgacagctcccaccgcacgtgggccctgctttcccaattgatatctttgctcacgattatagcttgcc

SEQ ID NO: 124825 - DNA, 18 bp, Homo sapiens
  misc_feature 1..18: note = chr5:110885341-110885359
  misc_feature 1..18: note = Hypo
  source 1..18: mol_type = genomic DNA
agaagactgagaggccgg

SEQ ID NO: 124826 - DNA, 17 bp, Homo sapiens
  misc_feature 1..17: note = chr5:111306228-111306245
  misc_feature 1..17: note = Hypo
  source 1..17: mol_type = genomic DNA
gaagtcttactgggtcg

SEQ ID NO: 124827 - DNA, 30 bp, Homo sapiens; identical to SEQ ID NO: 92751
  misc_feature 1..30: note = chr5:111602040-111602070
  misc_feature 1..30: note = Hypo
  source 1..30: mol_type = genomic DNA

SEQ ID NO: 124828 - DNA, 30 bp, Homo sapiens; identical to SEQ ID NO: 92753
  misc_feature 1..30: note = chr5:111706271-111706301
  misc_feature 1..30: note = Hypo
  source 1..30: mol_type = genomic DNA

SEQ ID NO: 124829 - DNA, 376 bp, Homo sapiens; identical to SEQ ID NO: 92754
  misc_feature 1..376: note = chr5:111754705-111755081
  misc_feature 1..376: note = Hyper
  source 1..376: mol_type = genomic DNA

SEQ ID NO: 124830 - DNA, 128 bp, Homo sapiens; identical to SEQ ID NO: 40578
  misc_feature 1..128: note = chr5:111813766-111813894
  misc_feature 1..128: note = Hypo
  source 1..128: mol_type = genomic DNA

SEQ ID NO: 124831 - DNA, 79 bp, Homo sapiens; identical to SEQ ID NO: 40579
  misc_feature 1..79: note = chr5:111875281-111875360
  misc_feature 1..79: note = Hypo
  source 1..79: mol_type = genomic DNA

SEQ ID NO: 124832 - DNA, 31 bp, Homo sapiens; identical to SEQ ID NO: 92758
  misc_feature 1..31: note = chr5:111987787-111987818
  misc_feature 1..31: note = Hypo
  source 1..31: mol_type = genomic DNA

SEQ ID NO: 124833 - DNA, 199 bp, Homo sapiens
  misc_feature 1..199: note = chr5:112043090-112043289
  misc_feature 1..199: note = Hyper
  source 1..199: mol_type = genomic DNA
agcgaagcagtgcccggcaagcggagcgcagcacccattgcgcctgcgcataacaggctctagtctccgggctgtgggaagccagcaacacctctcacgcatgcgcattgtagtcttcccacctcccacaagatggcggagggcaagtagcaagggggcggggtgtggccgccggaagcctagccgctgctcggggggg

SEQ ID NO: 124834 - DNA, 74 bp, Homo sapiens; identical to SEQ ID NO: 92759
  misc_feature 1..74: note = chr5:112073410-112073484
  misc_feature 1..74: note = Hyper
  source 1..74: mol_type = genomic DNA

SEQ ID NO: 124835 - DNA, 206 bp, Homo sapiens; identical to SEQ ID NO: 40581
  misc_feature 1..206: note = chr5:112198294-112198500
  misc_feature 1..206: note = Hypo
  source 1..206: mol_type = genomic DNA

SEQ ID NO: 124836 - DNA, 78 bp, Homo sapiens; identical to SEQ ID NO: 92762
  misc_feature 1..78: note = chr5:112629200-112629278
  misc_feature 1..78: note = Hyper
  source 1..78: mol_type = genomic DNA

SEQ ID NO: 124837 - DNA, 290 bp, Homo sapiens; identical to SEQ ID NO: 92763
  misc_feature 1..290: note = chr5:112629488-112629778
  misc_feature 1..290: note = Hyper
  source 1..290: mol_type = genomic DNA

SEQ ID NO: 124838 - DNA, 451 bp, Homo sapiens; identical to SEQ ID NO: 92764
  misc_feature 1..451: note = chr5:112630247-112630698
  misc_feature 1..451: note = Hyper
  source 1..451: mol_type = genomic DNA

SEQ ID NO: 124839 - DNA, 129 bp, Homo sapiens; identical to SEQ ID NO: 92765
  misc_feature 1..129: note = chr5:112823685-112823814
  misc_feature 1..129: note = Hyper
  source 1..129: mol_type = genomic DNA

SEQ ID NO: 124840 - DNA, 251 bp, Homo sapiens; identical to SEQ ID NO: 92766
  misc_feature 1..251: note = chr5:112824066-112824317
  misc_feature 1..251: note = Hyper
  source 1..251: mol_type = genomic DNA

SEQ ID NO: 124841 - DNA, 83 bp, Homo sapiens; identical to SEQ ID NO: 92768
  misc_feature 1..83: note = chr5:113391056-113391139
  misc_feature 1..83: note = Hyper
  source 1..83: mol_type = genomic DNA

SEQ ID NO: 124842 - DNA, 831 bp, Homo sapiens
  misc_feature 1..831: note = chr5:113391377-113392208
  misc_feature 1..831: note = Hyper
  source 1..831: mol_type = genomic DNA
ctctgcagctccccccggttaacacccgaaattcggccttagaatacacacacacgatggaatttgttccatatctttttttttaaccttcgataggcataaatccaaacctaaaattaaaatcatccccaaatttggttttgggaatcatgttggttttcacccttgagcggcgttccctccccagtgccgcatgctgcttaaggactgttactttcttggggagggaagtatcaaatggaaacggtgtgtgtgtgcgcgcgcgcgtttatttttggcgcatgcacacccctcggtagcctcaaggtcggcgataccctgagcattcgggcccccgcctgcaggactcgctcctgccagccaaggactcaagaaggagggagtccccagtcccggcggggcgcctgggattcggttcaatatttagcacagtcagtaccgaagcaggggcagccaggtgggagctgggcgcccaaaagttggaccccaatcagcagcgagtgggcagcgggggcctggctcgcccgcgcccgcgccccggagctctccggctggctctctgctccccgaagctggggagccgggggcgctctcccgggccgcaagcaggcacggaatttgacgcccgagaggcagatggtcctggctaggactcctgattcttctcagatggaaacagtttctcccggtgaacctgccggaattctcagtggactcgatcttcagctttgtccactggcgcatttcaccaaggccgcatttaccgctttgaggcaaatttgagcttcaaatggagcgggactcctggttgcagaacgaggtaaggtcgcg

SEQ ID NO: 124843 - DNA, 315 bp, Homo sapiens; identical to SEQ ID NO: 29821
  misc_feature 1..315: note = chr5:113696418-113696733
  misc_feature 1..315: note = Hyper
  source 1..315: mol_type = genomic DNA

SEQ ID NO: 124844 - DNA, 1216 bp, Homo sapiens
  misc_feature 1..1216: note = chr5:113696951-113698167
  misc_feature 1..1216: note = Hyper
  source 1..1216: mol_type = genomic DNA
gcccccacccacccccggccggggtgccgaggcggttaaccctacccgcgccgcagcgcacttgggctagagcgccgcgcacccaatccagattccagagcctgccggctgggaaagatccggtctcggggtcggctatgatcccgcagcggccaaggcagggctcaggccccgggattctccccacacgctgctgcactggcgcagccggtcgccaaactttttctccccaaagccagtgcccccgcagttacttggcgggcagccggcagcccactctcggcgggatgatctgggagaagcgggcgtgggacgagggggctgctgttttgcagccctgcgaggcgtgcagtcggagaagtggtcggggttccacaccgtccctgagcctgcccccggccaaggtggcccgacgtgctgcagtggctggcgcaggtgatccgggcagcgcgtccggcactagtcaagggggcagcggcacgggagggaggggcgcctttctcttttctcctccccctgcagcccagctgcactgcgtgggggctctccatctccacgcaatcagcaggcggaatccctgccctggagcgccctggctctggactgcacccccctagggtttgtcctgcagattcccctccccatctttctctgccacacacgcttccctaagccgcgcgcgccgcaaactcagtctcggtccccgcaggtgatgtcatgcccattgttttggtgcgcccaaccaatcggactcgccgcctggattctaccggagccggcatgggcccttcctcgcaccagcagcaggagtccccgctcccgaccataacgcattgcgcagggtgcaccaccgcttggtctccctgcagctttaacagccctgacatggaaaccccattgcagttccagcgcggcttcttcccagagcagccgccgccgccgccgcgctcctcacacctgcattgccagcagcagcaacagagccaggacaagccgtgcccgcccttcgcgcccctcccgcaccctcaccaccacccgcacctcgcgcaccagcagccggccagcggcggcagcagcccatgcctccggtgcaacagctgcgcctcctccggtgccccggcggcgggggcgggagataacctgtccctgctgctccgcacctcctcgcccggcggcgccttccggacccgcacctcctcgccgctgtcgggctcgt

SEQ ID NO: 124845 - DNA, 733 bp, Homo sapiens
  misc_feature 1..733: note = chr5:113698386-113699119
  misc_feature 1..733: note = Hyper
  source 1..733: mol_type = genomic DNA
accaccaccaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgcagcccctgcagccccccgcgtctgtcggaggaggtggcggcgcgtcctccccgtctgcagccgctgccgccgccgccgctgtttcgtcctcagcccccgagatcgtggtgtctaagcccgagcacaacaactccaacaacctggcgctctatggaaccggcggcggaggcagcactggaggaggcggcggcggtggcgggagcgggcacggcagcagcagtggcaccaagtccagcaaaaagaaaaaccagaacatcggctacaagctgggccaccggcgcgccctgttcgaaaagcgcaagcggctcagcgactacgcgctcatcttcggcatgttcggcatcgtggtcatggtcatcgagaccgagctgtcgtggggcgcctacgacaaggtacaggcttgaaccccagcccacgctaccggagtcgggcactgggtggttgggatgggcactggcggggaccctttgcgtgcggatccctagcctctccgggacgatcaagggagcccgccaggacagcgggcgcgtctaggacgcgcatccgtagtcag

SEQ ID NO: 124846 - DNA, 293 bp, Homo sapiens; identical to SEQ ID NO: 92777
  misc_feature 1..293: note = chr5:113699370-113699663
  misc_feature 1..293: note = Hyper
  source 1..293: mol_type = genomic DNA

SEQ ID NO: 124847 - DNA, 30 bp, Homo sapiens; identical to SEQ ID NO: 92781
  misc_feature 1..30: note = chr5:114506521-114506551
  misc_feature 1..30: note = Hyper
  source 1..30: mol_type = genomic DNA

SEQ ID NO: 124848 - DNA, 735 bp, Homo sapiens
  misc_feature 1..735: note = chr5:114514936-114515671
  misc_feature 1..735: note = Hyper
  source 1..735: mol_type = genomic DNA
gcactgactcaggcccggcaccaccccgcctgctgagggcgtcgtcgcgggcgccaccgacggcgccagcctgcgttcctaaaggctccaggacaggtgtggggctgaaatcccgctcctccagcatcttcccctccctaccaaaagaaggctgctttaaatattcccggcctggagcagcagcagctaaggacctggaaagaggcccgaaaaggccagggcagggcgaacgaacgtgctgtccctatttaccggccacacgctctgactgcgggctgaccctgatcgcacacttcgagcctgttcactcgctgggcggaccctccctccacgctccgcgcccaggcaggcgaggtcacccactcgaagtcaccacgtttgagtagccctggttggtggggcagcgcccccttggccaacgccccgccctcctctccatcttccgacgctgggctctcgcccttcggcgtccgagagcccctattgctgcccagctggccccaaaagcgtccgaaagtcccctcttggcttatttcagagatgccacgcaataaagaaaaggcggctactttgcattccgcagctgctgggacgcccgggctgcgagcgcggctcctggattccagcctcccgcccttcccaggcgctggaatggacacggacgcccacagtggcgggccaggtagtgccggagtcgggggcccaggccgcggcgccccgcgcctcatcacttac

SEQ ID NO: 124849 - DNA, 374 bp, Homo sapiens; identical to SEQ ID NO: 92784
  misc_feature 1..374: note = chr5:114515900-114516274
  misc_feature 1..374: note = Hyper
  source 1..374: mol_type = genomic DNA

SEQ ID NO: 124850 - DNA, 157 bp, Homo sapiens; identical to SEQ ID NO: 92785
  misc_feature 1..157: note = chr5:114972859-114973016
  misc_feature 1..157: note = Hypo
  source 1..157: mol_type = genomic DNA

SEQ ID NO: 124851 - DNA, 1702 bp, Homo sapiens
  misc_feature 1..1702: note = chr5:115151163-115152865
  misc_feature 1..1702: note = Hyper
  source 1..1702: mol_type = genomic DNA
gggggctgaaaaaaacgacggtcgaatatttaatctgcgaaacttggcagtggatttgaataaacccacagtcggggaagttagttaaattggtttgggaaagggaacagcagaaattccgtagtggcagctgacggccacaagacgctattttacatgagtaaaaatgcttgctataaggtgcccggttgcaggcgaccgaaggcgcagtgatggagaactgacgcgggtgacttgtcttcttcaacatcacacacttctcccgatggctgatgtagtgctcccctgggagcaccctctgctagtccggccagacggttccttaaggtgtcaggagggcccgaacctgagtgcggtctctccgcatctccgcgcccggggttaacgatggcttgggagtgtgggcattgctcccgaggccaggggcaggaggactggtggtttagaagcagaggggtttgcgggagagaagagaacagaaaatctcgcagacgcgcggtggcctcccttcccggcgcctgtccgccgttcccggccggaggtcagcaaggccagtaggatccaccttccgcctgcgctgtggccgcggagccccaagcgagtcgtgccagccccgcggctggccagcgagggggcgagcggcggacgcagcgcggcccgagcttcccgagccagtcactttgggctgcgtcccccacgtccattcctcctcagacggggcgagtgggcgccgcctggcattgaagctgcagcgcgctcacctgtactggtcgaacttggcgtacattgcccactcggtggggtcgctctcgtaggcttccatgatggcctgcacctcctctacattgacctcatcgccggcaaagagctggtgcaggatgcggatcagatcagccagggtccgtggcttcagcacttcggtctgttccatctcgtggggagctggctgcgcgcgcgtctcactgctgggctgcggtggaggagctgagcgagccaaggagctgggggcgagggagcctaacagcccgctagaccgctaagcagacacacacgcacaaacccagcattagagtgccgaaacgtaaggatgtcgtcgcagagacagcaagagacccacccccaggcccctggcagcgcagtggatccgggatcgctggagacgcggtgcacacacaaatcaggttcagatctgtggggttcatcctcccgggccccttttaagcgcttggagtcactaggaatgtaccaacggccctcggagggaggacgaggcggagagccacccaagaaaggtggcggaggcggggagaccctgcgggcacggctcacgcgcacatccccggcttccccgggctccgcgccttcccaagagccccgttgtctccggcgtcccagggatcgcgtgggctccgcgcaatctctcccccactttaacggcgcgttttagccgcccggcctaacgcctctccccgctccacctccgccgctgtggttcgcgacgctgggacgtagacaaaaagggtcggaggagatggctgcggggactgacgctgagtaaaggaggaaaagaaaagggaaggagagggacacttcttccaaatagagaattgtgaggagcctgcgaaaattgaggatggattccactcctaggccagagagtgcctgttttgtcgattgaaactatccacgatatgccccaggc

SEQ ID NO: 124852 - DNA, 32 bp, Homo sapiens; identical to SEQ ID NO: 40582
  misc_feature 1..32: note = chr5:115176272-115176304
  misc_feature 1..32: note = Hypo
  source 1..32: mol_type = genomic DNA

SEQ ID NO: 124853 - DNA, 1958 bp, Homo sapiens
  misc_feature 1..1958: note = chr5:115297158-115299116
  misc_feature 1..1958: note = Hyper
  source 1..1958: mol_type = genomic DNA
ttcccaattcaccagcgtgcgtgaatgcagactccagatccagcgcagacgccaagaattcgctcaggggcaccagctaaatagcaaacagatgccatgtcaaacatgtgaaagcctcagcgactagggtaccgccgggaaaaccagttccagcccaggaatttctgggtggaaacactggccgccgaattgttttattctctttgcttgattcgagtcggttctgaaagcaggtgtcccctctcccccggcttcaggaagggaaaccccggccccaggcagttgcagagctaagaaaaaccatcccgccaggccccttcttgtggtaacgcggtcctaaccctgctctgccccacaaccccatttcacccgggagacgcagacgccaggctccctagcactttgtcgcctcttcctccagcctggcttcctgagctctggaaaagttccgggcctccggacgttgtttccatcttcgccttcgctgcctgggccgcatgcctcctgggcttatttaggaagcgaagttagcgccacacatttggctccagaaatttgttctgacggcgcggccgacgccctgcagggtcatttctgaacgcattcccaaatatcctggtcctcaagcccttaccaccccctagcacacgaagccccagctggcggtggagcaggtgtgttgctggtagctcatcgctggcttggagatagaggtgcttggtacctgtcccctttccgacaacacctgaaaccgtatcggggcacacccctcatccaaatatccacgtttaaggtgtccggattcgtttggcttgaccaccccctccccgcgccaaccctggaggcatcttccgtggggtctgtctcttcgaacccaaaggggtacgcgtctgggtgagccaggtccgcctcttccctggcgctggccgggggcgggggtgggtaggctgggacctgtgtctgattagctgggagggggaagccatggtcccaaccgctgtctgctgagctccagtccgtccaggctcttccaggaggaagaggcacgatacaagagaggaggggcaggggtcgcagcactgaacaccctggccggggttttgacagctgccacagtctctgagctccagcctcgcgcctgaacccggtccctgccatggggcccccttccagctcaggcttctatgtgagccgcgcagtggccctgctgctggctgggctggtagccgccctcctgctggcgctggccgtactcgccgccttgtacggccactgcgagcgcgtcccaccgtcggagctgcctggactcagggacttggaagccgagtcttcccctcccctcaggcagaagccgacgccaaccccgaaacccagcagtgcacgcgagctagcggtgacgaccaccccgagcaactggcgacccccggggccctgggaccagctacgcctgccgccctggctcgtgccgctgcactacgatctggagctgtggccgcagctgaggcccgacgagcttccggccgggtctttgcccttcactggccgcgtgaacatcacggtgcgctgcacggtggccacctctcgactgctgctgcatagcctcttccaggactgcgagcgcgccgaggtgcggggacccctttccccgggcactgggaacgccacagtgggccgcgtgcccgtggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgtctacaccgaccagggcgagcgcaggtaagggctgtacagcccggggcccctctcggcccccgcccctgcgtcccggtgcaggctgcgggtccagctgactaccgtgtccaggtgcgcgtctgctgcccttt

SEQ ID NO: 124854 - DNA, 30 bp, Homo sapiens; identical to SEQ ID NO: 29841
  misc_feature 1..30: note = chr5:115908915-115908945
  misc_feature 1..30: note = Hyper
  source 1..30: mol_type = genomic DNA

SEQ ID NO: 124855 - DNA, 400 bp, Homo sapiens; identical to SEQ ID NO: 92797
  misc_feature 1..400: note = chr5:115909717-115910117
  misc_feature 1..400: note = Hyper
  source 1..400: mol_type = genomic DNA

SEQ ID NO: 124856 - DNA, 267 bp, Homo sapiens; identical to SEQ ID NO: 92798
  misc_feature 1..267: note = chr5:115910908-115911175
  misc_feature 1..267: note = Hyper
  source 1..267: mol_type = genomic DNA

SEQ ID NO: 124857 - DNA, 138 bp, Homo sapiens; identical to SEQ ID NO: 92799
  misc_feature 1..138: note = chr5:115911452-115911590
  misc_feature 1..138: note = Hyper
  source 1..138: mol_type = genomic DNA

SEQ ID NO: 124858 - DNA, 279 bp, Homo sapiens; identical to SEQ ID NO: 92800
  misc_feature 1..279: note = chr5:115911835-115912114
  misc_feature 1..279: note = Hyper
  source 1..279: mol_type = genomic DNA

SEQ ID NO: 124859 - DNA, 223 bp, Homo sapiens; identical to SEQ ID NO: 92801
  misc_feature 1..223: note = chr5:115958432-115958655
  misc_feature 1..223: note = Hypo
  source 1..223: mol_type = genomic DNA

SEQ ID NO: 124860 - DNA, 30 bp, Homo sapiens; identical to SEQ ID NO: 92802
  misc_feature 1..30: note = chr5:116052021-116052051
  misc_feature 1..30: note = Hypo
  source 1..30: mol_type = genomic DNA

SEQ ID NO: 124861 - DNA, 22 bp, Homo sapiens
  misc_feature 1..22: note = chr5:117258296-117258318
  misc_feature 1..22: note = Hypo
  source 1..22: mol_type = genomic DNA
ccgcgcccggccaaaatatccc

SEQ ID NO: 124862 - DNA, 1650 bp, Homo sapiens
  misc_feature 1..1650: note = chr5:119799856-119801506
  misc_feature 1..1650: note = Hyper
  source 1..1650: mol_type = genomic DNA
cctggcgcggcagcacggcgcccctctccgcgggcggggagcgagcgcgtgtgcgcgagagcgccgggcggcggcgggaggaggcgcaggcgcgctgctcgcccgtctgcagccccgagccgagcgccgcgtctcgggagttgatggcagcaccactgtgcggccgcccggccgagcgcggagcgcagccactcgccgctgcccagggagcgcccaagatgtggggggaccggggcggcagcggccgtagcagcgccagggacgggggcacgcagcagcctccgctcgcccgcctgtcctgacctgcctcgcttgcccccaaagaatgtcagccaagtccaaggggaacccctcctcgtcctgtccagccgagggaccgccggcagcctccaaaaccaaggtgaaggaacagatcaagatcatcgtggaggatttggaattagtcctgggcgacctgaaggacgtggccaaggaacttaaggaggtgagaggcgcaggggtggggagggagttcggcacccttcgacccctccggggtcccctttccgattttcagcagggacagccagatttccaaactcctgggaaactacagaaaaggcgcctgcagacggactttctttgctcctggagtcctgagaggagttgttgttgcactttttaatttttttttttaatcaggaagaaatcaactagtgttttaatcgatggacctgggctggtgggagggatgaacgcacgcgtgtctctgaatctgtgtgtgtgacgacgggggagagggttagctgggggtgtgtcggcagaggaagtcgtgagcagcccggctggagcgtgcaagatgctcctctcctgccctattgcttccccagagtcctttggcaagtccgctgcctatctgtcagcctccccaagtcagggctgaagaggggccgggttctgggccctgggccagatcagggagggcagcctggaggaagcttggctcagactaccctccctgtctctcgagcctcgctgtagggaaggcgacccgggctgctggcagccttggggctaaggagggggtctgggactttctcactttctcagtttctgaagcatcccctgctctcctccgaacgtcgttaccagtaactctgggccttcccgccaccctacctctgcttccttccttccaccctgtcgccacttggcattgaacccgagaagcaggacgcgcaggagagtgtatgtgtggccggggtcttgccattggcgtcctggctctctgcagctgggactgcttcggttcttccccgcttttcctatcccacttcggttcagccctactcccgcccgcccctagccccaggtgatccagatggaaagaagcagagaaggtgtcagggctgaggctgcgtaactcaggcggcggctccgggcgggggcgggggccgggctgggaggggtggggtctcccgagccaggctggctgccggcggcgtcgcggagctggtagcagagtcccagcgcgccgctcactactgaatggggtcctggtgcggttctcggtgagggagtccgcagctccgctgcgtgagagctaagactagaacttcgaaggtggcggtggctgcagcgggaaaaggggtggggcgtagtctaggtcca

SEQ ID NO: 124863 - DNA, 26 bp, Homo sapiens
  misc_feature 1..26: note = chr5:120884207-120884233
  misc_feature 1..26: note = Hypo
  source 1..26: mol_type = genomic DNA
aaaaaataacttgcccgccaggcaca

SEQ ID NO: 124864 - DNA, 1291 bp, Homo sapiens; identical to SEQ ID NO: 92822
  misc_feature 1..1291: note = chr5:121412520-121413811
  misc_feature 1..1291: note = Hyper
  source 1..1291: mol_type = genomic DNA

SEQ ID NO: 124865 - DNA, 56 bp, Homo sapiens; identical to SEQ ID NO: 92823
  misc_feature 1..56: note = chr5:121414034-121414090
  misc_feature 1..56: note = Hyper
  source 1..56: mol_type = genomic DNA

SEQ ID NO: 124866 - DNA, 1112 bp, Homo sapiens; identical to SEQ ID NO: 92824
  misc_feature 1..1112: note = chr5:121647381-121648493
  misc_feature 1..1112: note = Hyper
  source 1..1112: mol_type = genomic DNA

SEQ ID NO: 124867 - DNA, 292 bp, Homo sapiens; identical to SEQ ID NO: 92825
  misc_feature 1..292: note = chr5:121648747-121649039
  misc_feature 1..292: note = Hyper
  source 1..292: mol_type = genomic DNA

SEQ ID NO: 124868 - DNA, 40 bp, Homo sapiens; identical to SEQ ID NO: 92829
  misc_feature 1..40: note = chr5:122371217-122371257
  misc_feature 1..40: note = Hyper
  source 1..40: mol_type = genomic DNA

SEQ ID NO: 124869 - DNA, 30 bp, Homo sapiens; identical to SEQ ID NO: 92830
  misc_feature 1..30: note = chr5:122371686-122371716
  misc_feature 1..30: note = Hyper
  source 1..30: mol_type = genomic DNA

SEQ ID NO: 124870 - DNA, 30 bp, Homo sapiens; identical to SEQ ID NO: 92831
  misc_feature 1..30: note = chr5:122372558-122372588
  misc_feature 1..30: note = Hyper
  source 1..30: mol_type = genomic DNA

SEQ ID NO: 124871 - DNA, 86 bp, Homo sapiens
  misc_feature 1..86: note = chr5:122422237-122422323
  misc_feature 1..86: note = Hyper
  source 1..86: mol_type = genomic DNA
cgggggtccagcttacgccgctgcgcgcccttgtgcgcaccgggtgaggatgccgagctctgcgggcatcccggaagccgcggtgg

SEQ ID NO: 124872 - DNA, 218 bp, Homo sapiens; identical to SEQ ID NO: 29853
  misc_feature 1..218: note = chr5:122422616-122422834
  misc_feature 1..218: note = Hyper
  source 1..218: mol_type = genomic DNA

SEQ ID NO: 124873 - DNA, 208 bp, Homo sapiens; identical to SEQ ID NO: 92834
  misc_feature 1..208: note = chr5:122423168-122423376
  misc_feature 1..208: note = Hyper
  source 1..208: mol_type = genomic DNA

SEQ ID NO: 124874 - DNA, 30 bp, Homo sapiens; identical to SEQ ID NO: 92835
  misc_feature 1..30: note = chr5:122423599-122423629
  misc_feature 1..30: note = Hyper
  source 1..30: mol_type = genomic DNA

SEQ ID NO: 124875 - DNA, 231 bp, Homo sapiens; identical to SEQ ID NO: 92836
  misc_feature 1..231: note = chr5:122423874-122424105
  misc_feature 1..231: note = Hyper
  source 1..231: mol_type = genomic DNA

SEQ ID NO: 124876 - DNA, 252 bp, Homo sapiens; identical to SEQ ID NO: 29856
  misc_feature 1..252: note = chr5:122424436-122424688
  misc_feature 1..252: note = Hyper
  source 1..252: mol_type = genomic DNA

SEQ ID NO: 124877 - DNA, 1939 bp, Homo sapiens
  misc_feature 1..1939: note = chr5:122424910-122426849
  misc_feature 1..1939: note = Hyper
  source 1..1939: mol_type = genomic DNA
aacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcacgcacccaccggcagcaccgagttttcaggtaaggtgaggctggtctgggacttaagagtctagggcttggtagataggaaggttggtggtcctaggttgggggcgggcggcgagactgttctgcctcctggcgcctgaggccaacgcggctcgggcgctgcgccacgccggctcgggtcggctccgggcgctggctgagggcgggggctgcgtcctgcagccgagttctacggggcagcgccctcctgtcgggccccagcattgctggatgggagctggacgctgcgatcggggaggcagagcagggtgcacacagctccctctgtgcggcgccgcagcttcggagtaaactttgcgcccaagcggagttgggaagagggagccgcggaaccgggcggccgccggctgaaccaccggctcgggcactttctccagggtcccagtggccctcttcccggcccctttcgcccagctcacgcgccccctcttccctgccctctgcccccagttcgaggcgccggacatgctgaagcccggagaccccggcggttcggccttcctcaaagtggacccagcctacctgcagcactggcagcaactcttccctcacggaggcgcaggcccgctcaagggcagcggcgccgcgggtctcctgagcgcgccgcagcctcttcagccgccgccgccgcccccgcccccggagcgcgctgagcctccgccggacagcctgcgcccgcggcccgcctctctctcctccgcctcgtccacgccggcttcctcttccacctccgcctcctccgcctcctcctgcgctgctgcggccgctgccgccgcgctggctggtctctcggccctgccggtgtcgcagctgccggtgttcgcgcctctagccgccgctgccgtcgccgccgagccgctgccccccaaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgtacgtagccgcagcccgcgcgctctctcccggggcgccggcgccggcgccggcgggcgcgggtgcctgtcagggaggcgggtcggataggagtgacacggggccgggtgggtggggagcacctggtcctggccgctggcccgcgcctccccgatctctgtgacaaaagttttctggcgttggagaaggaaagagaacggatgggacggccggtggcactttggggttccctctccctccctctcctcacctgcttcacagtcccaagtgtttggggccggagtctaccgtggacccggcctaacagacctctgccctcccgccggacagtgcccggggccaggcgggtactggcagcgtgtgacagggggtgtctgggtcaggccctgcctggccttagccgggacgagggagggaccctcagcgtctctggggagcacgcagaccagggcttgtttttgctactctccaccccacctctggaggggtcattttcgggccgcggggttgtgggggaaccggcgggagctgttcgctggccaggcctc

SEQ ID NO: 124878 - DNA, 1031 bp, Homo sapiens; identical to SEQ ID NO: 92842
  misc_feature 1..1031: note = chr5:122430402-122431433
  misc_feature 1..1031: note = Hyper
  source 1..1031: mol_type = genomic DNA

SEQ ID NO: 124879 - DNA, 47 bp, Homo sapiens
  misc_feature 1..47: note = chr5:122434072-122434119
  misc_feature 1..47: note = Hyper
  source 1..47: mol_type = genomic DNA
ggtcgcgccggcgggcgccgaggccaccttctcggggcaggccatcc

SEQ ID NO: 124880 - DNA, 302 bp, Homo sapiens
  misc_feature 1..302: note = chr5:122434428-122434730
  misc_feature 1..302: note = Hyper
  source 1..302: mol_type = genomic DNA
aacaattaggctgatcgttaaatttgctattcctttcttccggcgtctagggagagcgtgcacaccaaaccctccagaacagcaccccggtcccccaccccgccccacctgtccccgccctgcttcagtgcctggagggagaactgactggtcgcttgagggaccccatttcgggcgcgcccttggagtcctggggctgcggctcctgctctaccgggctgcaggcttgctctgccccgtcccgtggcgtttgggaggcagtcgaggaagcctccgagtctctgggtcgaaggaagtgcgaa

SEQ ID NO: 124881 - DNA, 58 bp, Homo sapiens
  misc_feature 1..58: note = chr5:122621293-122621351
  misc_feature 1..58: note = Hyper
  source 1..58: mol_type = genomic DNA
tcccagggcctgaggcgcaggaacccactgcccggggccccagcgctgtcagcccctc

SEQ ID NO: 124882 - DNA, 30 bp, Homo sapiens; identical to SEQ ID NO: 92849
  misc_feature 1..30: note = chr5:124082412-124082442
  misc_feature 1..30: note = Hyper
  source 1..30: mol_type = genomic DNA

SEQ ID NO: 124883 - DNA, 516 bp, Homo sapiens; identical to SEQ ID NO: 92850
  misc_feature 1..516: note = chr5:124083366-124083882
  misc_feature 1..516: note = Hyper
  source 1..516: mol_type = genomic DNA

SEQ ID NO: 124884 - DNA, 107 bp, Homo sapiens; identical to SEQ ID NO: 92851
  misc_feature 1..107: note = chr5:124084195-124084302
  misc_feature 1..107: note = Hyper
  source 1..107: mol_type = genomic DNA

SEQ ID NO: 124885 - DNA, 206 bp, Homo sapiens; identical to SEQ ID NO: 92852
  misc_feature 1..206: note = chr5:124084771-124084977
  misc_feature 1..206: note = Hyper
  source 1..206: mol_type = genomic DNA

SEQ ID NO: 124886 - DNA, 84 bp, Homo sapiens; identical to SEQ ID NO: 92853
  misc_feature 1..84: note = chr5:124128502-124128586
  misc_feature 1..84: note = Hypo
  source 1..84: mol_type = genomic DNA

SEQ ID NO: 124887 - DNA, 476 bp, Homo sapiens; identical to SEQ ID NO: 92856
  misc_feature 1..476: note = chr5:125930586-125931062
  misc_feature 1..476: note = Hyper
  source 1..476: mol_type = genomic DNA

SEQ ID NO: 124888 - DNA, 30 bp, Homo sapiens; identical to SEQ ID NO: 92857
  misc_feature 1..30: note = chr5:125931300-125931330
  misc_feature 1..30: note = Hyper
  source 1..30: mol_type = genomic DNA

SEQ ID NO: 124889 - DNA, 18 bp, Homo sapiens
  misc_feature 1..18: note = chr5:125937930-125937948
  misc_feature 1..18: note = Hypo
  source 1..18: mol_type = genomic DNA
gcccggcccagcttccct

SEQ ID NO: 124890 - DNA, 337 bp, Homo sapiens; identical to SEQ ID NO: 92859
  misc_feature 1..337: note = chr5:126199749-126200086
  misc_feature 1..337: note = Hypo
  source 1..337: mol_type = genomic DNA

SEQ ID NO: 124891 - DNA, 35 bp, Homo sapiens; identical to SEQ ID NO: 92860
  misc_feature 1..35: note = chr5:126327499-126327534
  misc_feature 1..35: note = Hypo
  source 1..35: mol_type = genomic DNA

SEQ ID NO: 124892 - DNA, 97 bp, Homo sapiens; identical to SEQ ID NO: 92861
  misc_feature 1..97: note = chr5:126328776-126328873
  misc_feature 1..97: note = Hypo
  source 1..97: mol_type = genomic DNA

SEQ ID NO: 124893 - DNA, 150 bp, Homo sapiens; identical to SEQ ID NO: 92862
  misc_feature 1..150: note = chr5:126339372-126339522
  misc_feature 1..150: note = Hypo
  source 1..150: mol_type = genomic DNA

SEQ ID NO: 124894 - DNA, 144 bp, Homo sapiens; identical to SEQ ID NO: 92863
  misc_feature 1..144: note = chr5:126366959-126367103
  misc_feature 1..144: note = Hyper
  source 1..144: mol_type = genomic DNA

SEQ ID NO: 124895 - DNA, 30 bp, Homo sapiens; identical to SEQ ID NO: 40585
  misc_feature 1..30: note = chr5:126409452-126409482
  misc_feature 1..30: note = Hypo
  source 1..30: mol_type = genomic DNA

SEQ ID NO: 124896 - DNA, 385 bp, Homo sapiens; identical to SEQ ID NO: 92866
  misc_feature 1..385: note = chr5:126626332-126626717
  misc_feature 1..385: note = Hyper
  source 1..385: mol_type = genomic DNA

SEQ ID NO: 124897 - DNA, 30 bp, Homo sapiens; identical to SEQ ID NO: 40586
  misc_feature 1..30: note = chr5:126851264-126851294
  misc_feature 1..30: note = Hypo
  source 1..30: mol_type = genomic DNA

SEQ ID NO: 124898 - DNA, 146 bp, Homo sapiens; identical to SEQ ID NO: 92869
  misc_feature 1..146: note = chr5:127537084-127537230
  misc_feature 1..146: note = Hyper
  source 1..146: mol_type = genomic DNA

SEQ ID NO: 124899 - DNA, 2332 bp, Homo sapiens
  misc_feature 1..2332: note = chr5:127872845-127875177
  misc_feature 1..2332: note = Hyper
  source 1..2332: mol_type = genomic DNA
ccgcccgctgagctgcggggttgggaaggaaaagggggacgcgctcctgggggtctttggatattctggcaaagggggctgcagctctaggctccagctaaagggtctgggacggagtgggccagaaagccgccaaactgaggattcccccctcccccaagccggagccctaggtgcggagccgcttgcccacttaccctcggagcacgtcctgctgtcctcgccggcggacgcggctggccactgcggcaccctcctcgcgatactcgggcgctagaaacccgccttcagagcctgctgtagcggaccgaacctgttgcggcggcggctggggccggggcggcttgggcggaggaggctgaggctggccggccgtgccctgcgcccagagcaccacacagcccagccacaggaagtagagctggagacacagcctccgtcttctccccatcgccggcgccgaaagcgcgcggccgtagacccgcggagagggagtgatcaaagacaaaatctgcgcgcctcagaaaagagtcagggtctaataagcccttcgtcggctccggggactccctcgggctcgggctccctgctctagctggagacctcgacagagcgccggccccctgactgcccgcgaagcgagacgcggggcgccgggtctagcgcagtgagcggcgaggcgcggcggaggtgcagccggcagccccgagcggtacacgttgcataaccggcctaaagccccgagcgactccaggaccgtcagcgggcgggggaggaaattacaaaagccctggcgtaaaatttcaaaaaatgtgaacctcaaaagaaaaaagggcctgcacgcagagctcggcggattcccgtgcgctccgaagacggatattggaaagctgcaaaagtcaccagaaagaaacaggcaagcaaacaaaagtcgcccccagaagaagaggagggttccctccgggctcgctcggagtcccacagggcaacgaagcgcgggtagcggctgcggagccgggcggaggtgcgcggggccggggcgtgcggccagcaagagagagggcgggaggctgggcgctggagaagatgcggcggtggagggcgcggcgcgggggttttagaggcccggcggggcgcggggcgggccggcgggcggcggctgtcagtgggggcgcggccgtccacacgtggggctcaacccggactgagaggccggcgcagagtgggcggggacagagtaagggagagatcgggactgaggaacgaggggaaccagggttgggtgaggggaagaggaaggaagggggggagggcgaagggagggaagaggacggagattggggagaaggggggcgaacccgagaggaaggccgggctggaagagggacttggaaagagggattggcgagcccgggtgcgagaggaaatgagcgggggatgggggcgaagttagggcaaagagagaagtgggaaaggagagggagggccaaggtccgggcgccgagaggaggggcccggggggccggctggagggggcgaggcgctaggcggctttgcttcccgtccccgtcaattggccgctagctctgttttgactgcctgtacaaagcgagtagacggcgggggatggggcgattagggaccggatttgggaaaggaggcagcagccccttcccctccccctccgtcctcgcccggccgcggaccagggactagggtgcctaagcgcgccaggcttggccggacccgcagctgaactgacccgcagctgaacttccccgccggacagaggccgcaaggttgaggatgagaacgggtctttctgtagggtcccggcccctgacctgggatggggggattcgcagtcagccaggaatagaggctcacggggctgttggttgcagcctcaatccaagaaggaggagacctcccctttgccctcctacccccaccgccccaccgggagcggcgtcagtctgcgggaccaaattaggggctgggagtttccagattgaaatgcgccctccaccaccaagagggagctcacgcggccgcggggggccgaggcagccagccggcgccgcggtcctggggagtccgtgcaggggtgtgctctggtgtgaaacctggcaggactctgcctgggcttgcatgcagggaggggttagagactctgaaatgtactagcgggcagggtggtgacaaggcgggtaaatgaggctcggggcatgcccttgcttcctggcttggaccccttctgattgattaaatcctagcaattggtgcaaccctctgtacctcttagagtgcctctcaccggcctgctctgggt

SEQ ID NO: 124900 - DNA, 656 bp, Homo sapiens
  misc_feature 1..656: note = chr5:128300655-128301311
  misc_feature 1..656: note = Hyper
  source 1..656: mol_type = genomic DNA
tggatgacctttgtgcgacactgttataccttatcagcctcgccagggcccccgcgccgcccaatcccagcaactctggttctcctgtgaccccaagccttccagatccctgggtttccccccacgggactgtcacattcttccccgccggagacgccagtcgcggggcctcctccctggggtgtgagcaggtcggcgcgccacacttctctaggtggccggacgcgcgcccagggaggagctggcggcggggcccaggctgttccggctgcggcacgccaggggatgtggttagccctgagcctggaggccgaaggtgggcaggcaacactcccaccatgtttcggaggagaatacactaggctagcctaacgacactcggagtgcgagctgcggctggggtaggggcacccctttccagcgggcgcgtgggtcaccaaggagcagttctccgggacccgttgcgtcagagggactgggcggggctgggcggggcaggacgggggcggcgctcaggaaccctggaacccgctggccctgaggccacggaccgagacgtggtgctgagcccctgcgcggtttctggtgcgtagagactgtaaatcgctgcgcttctcagtcatcatcatcccagcttttcccggctcgaattcagc

SEQ ID NO: 124901 - DNA, 2014 bp, Homo sapiens
  misc_feature 1..2014: note = chr5:128795456-128797470
  misc_feature 1..2014: note = Hyper
  source 1..2014: mol_type = genomic DNA
acccacctctctagtcgtgtcttcccatctccctactcattccctcccgcgccgctgcgggtgagagccttcagcggtgcgtcctaaggagcgtgaggagtgtgcggagcttggcacaccaagttgctgagactgtgacaccagcctccgcccgttccgcgcgggtgcaggcggcgagcctcggctcggacaccacagctctcctgcccgcgccgggcagtcctctgcctgtccagaggcagcactcccggctctcggctggctgtgggtctgtcttgtggggctccagcactagcctgctcggcctcggaaactcctgcagcgtccagaacacagaaaatagactcatctcctaattcgccagggagctcgagggctgcggggccgcggggctgcctcccccgctcctcccccaacccgaccccaccccacccccgccagggcttcggcggcctcccggagtcacacagcctacccccccaccccaacaccccctcccccggcagacaaagggcctgggcaaattcgccgcccggcctcctagcgctccggggaggccgctgcgccccggagtggatcgcgctggaggcgtgcgccgggcgagaagccgcggccgcgggagcgcagtatggggaagaaccgcgagatgcgcctgactcacatctgctgctgctgcctcctttaccagctggggttcctgtcgaatgggatcgtttcaggtaagttcttccgtgactttctcgcttcctttccagccatcccagcggagaccgcgaacgtacgggtcggcagggctggtgcaaccggtgcgtggagagcagggctcagtgggtagcaataaaaatgagcttgaggtgcaggttaaggggtcaagttcggaaatgaagcacacttctgccggcctcgttttaaccgtatgtggaatagtttccttctaattagagcaataatatttgcaaaggtacgtttacagcacctggaggaaaattagaacgtacctaagttgatagcaacgctctgctctagcatacacttcagaaatcgtttactcgtgctggagtctttgcatcggttttcttttcaacaatgaagtgcggtcaccaaactttgattccccctcccccgcccctaatataatcgtacttttactctgaaaatgctggggtctgtaatctgatcgcaaggcttctggggttgcagagtttcagggtctagacgggtggtctccattgcattcaacgcgagcgccctgtatctatggactgtgagcttggaaatgtttgtgctactggaaccgcggcactttaagccccgcacttctgtctgccccgcccgcagagctgcagttcgcccccgaccgcgaggagtgggaagtcgtgtttcctgcgctctggcgccgggagccggtggacccggctggcggcagcgggggcagcgcggacccgggctgggtgcgcggcgttgggggcggcggaagcgcccgggcgcaggctgccggcagctcacgcgaggtgcgctctgtggctccggtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatccgccccgcaacctcccgcgccaccagacgcaggctgcttctacaccggagctgtgctgcggcaccctggctcgctggcttctttcagcacctgtggaggtggcctggtaagcgccttctttcccta

SEQ ID NO: 124902 - DNA, 45 bp, Homo sapiens; identical to SEQ ID NO: 92881
  misc_feature 1..45: note = chr5:129239737-129239782
  misc_feature 1..45: note = Hyper
  source 1..45: mol_type = genomic DNA

SEQ ID NO: 124903 - DNA, 877 bp, Homo sapiens; identical to SEQ ID NO: 92882
  misc_feature 1..877: note = chr5:129240024-129240901
  misc_feature 1..877: note = Hyper
  source 1..877: mol_type = genomic DNA

SEQ ID NO: 124904 - DNA, 35 bp, Homo sapiens; identical to SEQ ID NO: 92883
  misc_feature 1..35: note = chr5:129241105-129241140
  misc_feature 1..35: note = Hyper
  source 1..35: mol_type = genomic DNA

SEQ ID NO: 124905 - DNA, 466 bp, Homo sapiens; identical to SEQ ID NO: 92884
  misc_feature 1..466: note = chr5:129241413-129241879
  misc_feature 1..466: note = Hyper
  source 1..466: mol_type = genomic DNA

SEQ ID NO: 124906 - DNA, 30 bp, Homo sapiens; identical to SEQ ID NO: 92889
  misc_feature 1..30: note = chr5:130331203-130331233
  misc_feature 1..30: note = Hypo
  source 1..30: mol_type = genomic DNA

SEQ ID NO: 124907 - DNA, 92 bp, Homo sapiens; identical to SEQ ID NO: 40587
  misc_feature 1..92: note = chr5:131305994-131306086
  misc_feature 1..92: note = Hypo
  source 1..92: mol_type = genomic DNA

SEQ ID NO: 124908 - DNA, 403 bp, Homo sapiens; identical to SEQ ID NO: 92891
  misc_feature 1..403: note = chr5:131346834-131347237
  misc_feature 1..403: note = Hyper
  source 1..403: mol_type = genomic DNA

SEQ ID NO: 124909 - DNA, 162 bp, Homo sapiens; identical to SEQ ID NO: 92892
  misc_feature 1..162: note = chr5:131347627-131347789
  misc_feature 1..162: note = Hyper
  source 1..162: mol_type = genomic DNA

SEQ ID NO: 124910 - DNA, 427 bp, Homo sapiens
  misc_feature 1..427: note = chr5:131593088-131593515
  misc_feature 1..427: note = Hyper
  source 1..427: mol_type = genomic DNA
agctgggtttgggtccgcggcctgcagatccaaggcccgagcaggatccaggccgtcggggccgtccgaacgcggggatctctgagagctgagtgggggtgccgggttgccggcagccggggctgagggcgggtcctcagagccccccgaagtgggagggtcgggctggccgcggggccaatccaggcgcacagggagcgggggcgggggctgggccgagtggggacaggggcgggcgggccgggggcgggcgcggcgtccaggcggcggcggcggctgcggcggcggcggctcctcctcagagtccggctcaggctccggctgcggctccagcccgcgatgccccattccgtgaccctgcgcgggccttcgccctggggcttccgcctggtgggcggccgggacttcagcgcgcccctcaccatct

SEQ ID NO: 124911 - DNA, 30 bp, Homo sapiens; identical to SEQ ID NO: 92895
  misc_feature 1..30: note = chr5:131608230-131608260
  misc_feature 1..30: note = Hypo
  source 1..30: mol_type = genomic DNA

SEQ ID NO: 124912 - DNA, 30 bp, Homo sapiens; identical to SEQ ID NO: 92896
  misc_feature 1..30: note = chr5:131608541-131608571
  misc_feature 1..30: note = Hyper
  source 1..30: mol_type = genomic DNA

SEQ ID NO: 124913 - DNA, 227 bp, Homo sapiens; identical to SEQ ID NO: 92897
  misc_feature 1..227: note = chr5:131610019-131610246
  misc_feature 1..227: note = Hypo
  source 1..227: mol_type = genomic DNA

SEQ ID NO: 124914 - DNA, 267 bp, Homo sapiens; identical to SEQ ID NO: 92898
  misc_feature 1..267: note = chr5:131613605-131613872
  misc_feature 1..267: note = Hypo
  source 1..267: mol_type = genomic DNA

SEQ ID NO: 124915 - DNA, 30 bp, Homo sapiens; identical to SEQ ID NO: 40589
  misc_feature 1..30: note = chr5:131787174-131787204
  misc_feature 1..30: note = Hypo
  source 1..30: mol_type = genomic DNA

SEQ ID NO: 124916 - DNA, 242 bp, Homo sapiens
  misc_feature 1..242: note = chr5:131800302-131800544
  misc_feature 1..242: note = Hyper
  source 1..242: mol_type = genomic DNA
gcttgctgtcagccccgggggtggtttcctctctaggaaaagctaatgtcatgcttatgctgaaaaactcttttcagaggtactttaggaggggcctggctctcgattaatctgggccatttcataccggctgtgctcacccaggcacaaacactgaaagcaacagctggcaaagccatcgcttggtagcagcttggaagacaccaccaaagaagctctcatggaagcggcagatttcctga

SEQ ID NO: 124917 - DNA, 532 bp, Homo sapiens; identical to SEQ ID NO: 92900
  misc_feature 1..532: note = chr5:131991814-131992346
  misc_feature 1..532: note = Hyper
  source 1..532: mol_type = genomic DNA

SEQ ID NO: 124918 - DNA, 492 bp, Homo sapiens
  misc_feature 1..492: note = chr5:132083017-132083509
  misc_feature 1..492: note = Hyper
  source 1..492: mol_type = genomic DNA
aggcgcggcccggtgcgccagaggtagctccaccgcgagcgttgtgggtggggcccgccgagcccgcctccccacctcccccggcggcgccccaggctgcagtgttccgggagctgggttataaaatgccgggttaagcggcaactcagactcaggatcccgctcacgacatggcctcgggcgctcagctcccgccgcagccgtcgagctcagaggtcagcgccgtccagagcccaggcgggcgtcccggcgccggtctggaggaaacagccctgggcgttcctctcccgccgtctccgggggaggcccctctgccccgaagcaaccggagcaggtgccctgggacccgccagcccggagcggcctccctccacgcggcgtccgcagcagtccccgtgcggccccggcgcggtacggcgccagccgggaaaaccgcagacgcggtccccgccgccgccccagagcaagctccgcggccggctccacagtccc

SEQ ID NO: 124919 - DNA, 98 bp, Homo sapiens; identical to SEQ ID NO: 92903
  misc_feature 1..98: note = chr5:132083866-132083964
  misc_feature 1..98: note = Hypo
  source 1..98: mol_type = genomic DNA

SEQ ID NO: 124920 - DNA, 77 bp, Homo sapiens; identical to SEQ ID NO: 92904
  misc_feature 1..77: note = chr5:132113493-132113570
  misc_feature 1..77: note = Hyper
  source 1..77: mol_type = genomic DNA

SEQ ID NO: 124921 - DNA, 96 bp, Homo sapiens
  misc_feature 1..96: note = chr5:132149831-132149927
  misc_feature 1..96: note = Hyper
  source 1..96: mol_type = genomic DNA
caccgagagaccctccgcagacgcggccccaccgcctagggccccttctgaggcggcatcgccctgctctgatccgccagacgcggagcccgggcc

SEQ ID NO: 124922 - DNA, 54 bp, Homo sapiens; identical to SEQ ID NO: 92905
  misc_feature 1..54: note = chr5:132201467-132201521
  misc_feature 1..54: note = Hypo
  source 1..54: mol_type = genomic DNA

SEQ ID NO: 124923 - DNA, 20 bp, Homo sapiens
  misc_feature 1..20: note = chr5:132399919-132399939
  misc_feature 1..20: note = Hypo
  source 1..20: mol_type = genomic DNA
aggtgcggtggctcacgcct

SEQ ID NO: 124924 - DNA, 30 bp, Homo sapiens; identical to SEQ ID NO: 92907
  misc_feature 1..30: note = chr5:132759633-132759663
  misc_feature 1..30: note = Hyper
  source 1..30: mol_type = genomic DNA

SEQ ID NO: 124925 - DNA, 60 bp, Homo sapiens; identical to SEQ ID NO: 92908
  misc_feature 1..60: note = chr5:132888793-132888853
  misc_feature 1..60: note = Hyper
  source 1..60: mol_type = genomic DNA

SEQ ID NO: 124926 - DNA, 1822 bp, Homo sapiens; identical to SEQ ID NO: 92909
  misc_feature 1..1822: note = chr5:132946707-132948529
  misc_feature 1..1822: note = Hyper
  source 1..1822: mol_type = genomic DNA

SEQ ID NO: 124927 - DNA, 30 bp, Homo sapiens; identical to SEQ ID NO: 92910
  misc_feature 1..30: note = chr5:133262317-133262347
  misc_feature 1..30: note = Hypo
  source 1..30: mol_type = genomic DNA

SEQ ID NO: 124928 - DNA, 168 bp, Homo sapiens; identical to SEQ ID NO: 92911
  misc_feature 1..168: note = chr5:133406834-133407002
  misc_feature 1..168: note = Hyper
  source 1..168: mol_type = genomic DNA

SEQ ID NO: 124929 - DNA, 251 bp, Homo sapiens; identical to SEQ ID NO: 92912
  misc_feature 1..251: note = chr5:133449673-133449924
  misc_feature 1..251: note = Hyper
  source 1..251: mol_type = genomic DNA

SEQ ID NO: 124930 - DNA, 27 bp, Homo sapiens
  misc_feature 1..27: note = chr5:133682096-133682123
  misc_feature 1..27: note = Hypo
  source 1..27: mol_type = genomic DNA
ttgttaaatttgtcacgcttttctctt

SEQ ID NO: 124931 - DNA, 120 bp, Homo sapiens; identical to SEQ ID NO: 92914
  misc_feature 1..120: note = chr5:133820016-133820136
  misc_feature 1..120: note = Hypo
  source 1..120: mol_type = genomic DNA

SEQ ID NO: 124932 - DNA, 71 bp, Homo sapiens; identical to SEQ ID NO: 92915
  misc_feature 1..71: note = chr5:134242171-134242242
  misc_feature 1..71: note = Hypo
  source 1..71: mol_type = genomic DNA

SEQ ID NO: 124933 - DNA, 30 bp, Homo sapiens; identical to SEQ ID NO: 92916
  misc_feature 1..30: note = chr5:134256782-134256812
  misc_feature 1..30: note = Hypo
  source 1..30: mol_type = genomic DNA

SEQ ID NO: 124934 - DNA, 96 bp, Homo sapiens; identical to SEQ ID NO: 92917
  misc_feature 1..96: note = chr5:134339741-134339837
  misc_feature 1..96: note = Hypo
  source 1..96: mol_type = genomic DNA

SEQ ID NO: 124935 - DNA, 30 bp, Homo sapiens
  misc_feature 1..30: note = chr5:134363215-134363245
  misc_feature 1..30: note = Hyper
  source 1..30: mol_type = genomic DNA
cggacaggctcgcaacgcaggacggtgccc

SEQ ID NO: 124936 - DNA, 47 bp, Homo sapiens
  misc_feature 1..47: note = chr5:134363562-134363609
  misc_feature 1..47: note = Hyper
  source 1..47: mol_type = genomic DNA
gcagggccctggggccgcgccccttgctctgccggctcgactcttgc

SEQ ID NO: 124937 - DNA, 92 bp, Homo sapiens
  misc_feature 1..92: note = chr5:134364113-134364205
  misc_feature 1..92: note = Hyper
  source 1..92: mol_type = genomic DNA
gcgccgcgtgccctccgcggagtgggcctccggggcccgtgggaacacacacaccacccgcgccatcccgagagaaattgcaactcatccat

SEQ ID NO: 124938 - DNA, 332 bp, Homo sapiens
  misc_feature 1..332: note = chr5:134364265-134364597
  misc_feature 1..332: note = Hyper
  source 1..332: mol_type = genomic DNA
ctttttggagggcagagtggggtccggaaaagcaaacacaaaaccaacccggagtgggaagtgggaggagggggctgcgcaggtgtgaggtccgcggcgcggtgagctggggcttgcgagccggggccccgcgtgcgtcctccgcgcccgcgcccgcgcccttccccgctccggccgccggcccgcgtggtgcggcggggcggtcagctgttgtactggcacgcgttgaggcccgaggccgggccctgcaggccgccgtagccaaacgacgagtgctgtttggacttgagccgcaggctggctaggctcgagttgcacgtgtcccggtagac

SEQ ID NO: 124939 - DNA, 67 bp, Homo sapiens; identical to SEQ ID NO: 92918
  misc_feature 1..67: note = chr5:134365027-134365094
  misc_feature 1..67: note = Hyper
  source 1..67: mol_type = genomic DNA

SEQ ID NO: 124940 - DNA, 587 bp, Homo sapiens
  misc_feature 1..587: note = chr5:134366718-134367305
  misc_feature 1..587: note = Hyper
  source 1..587: mol_type = genomic DNA
ggggttgccttagtccgaggatcaggtaggatgagggtcaaaggggttgaaggtccgaggcgcctggaggcctggcagacgctagtgggccagggcctaaggtggggatctccggtggagggagggagcaggtctgaatggtgggagagtgaagttctgcttgtgggtctaagctttggagggctgcagcagaggcggcccgggagccctctgcgcgggtgcccttaggcgcgcaccccttgctcacccgcacgcgcggctcggtgaggttggtccacacggcgatctcctccctcatgctcatgtcggggtagcggttcctctggaacgtggcctctagctcttgcaactgctggcttgtgaagtgcgtacgttgccgccgctgcttcttcttcttggctgggtcgtctgcgccgccgcagcccgtgcctcccgcaccactgtcctcgggccccttgggttccccgccgcgctccttctctgcagtaggcaggacggggagcgggtcacctgggcttacgccccgttgcaccccgtcccggctccaccgaaccgctcgccaccagcgctggcggtcttccctccct

SEQ ID NO: 124941 - DNA, 124 bp, Homo sapiens; identical to SEQ ID NO: 92921
  misc_feature 1..124: note = chr5:134368720-134368844
  misc_feature 1..124: note = Hyper
  source 1..124: mol_type = genomic DNA

SEQ ID NO: 124942 - DNA, 1404 bp, Homo sapiens
  misc_feature 1..1404: note = chr5:134374447-134375851
  misc_feature 1..1404: note = Hyper
  source 1..1404: mol_type = genomic DNA
tcaatttcagaaatccgagacccggttcttgagaagcgactgcgtgctccgggaccctgcgtcaacaaccaaacctgggagaagccgcgggaatgtctttattggacgttacgaagggaattggggtttctctcctgggaagaaaaagcccgacctgtgccggcgagagcaggctgccttgggctgggggcacctccgagcgctgcggcgggacgtcggggtccggggcgaagagagccagggcgcggaccgacgtctgctgcttttctgcggcattgctgcccgaacgaacgaacgaacgaacgaacgaagcggtttcgtttaggaaaaataccctcttgacgcgaagccacggctgaagtcccgggccacgcagaggggccagcaattccatgggtggtggggccctccatccctggacgcagcggggagcagcgggcggccctctctcctgcccacttctcctgggggtgggggagccctgtgtcacccgacgctgcgaggggctgccacgggcttctcaggttgtgcccttcgcggggccgtggcccgtgcccccgaggctgctaccctcttgaggtgcccggagccaaagcagagggttgatcccgccggttgggtgaggtagcacccggtgacggcggctatgactgtgccctgggcgcaggaacgagctcctcgcgctgcctcgaaggctcctgaccttccgcgccttgcgctgtcccgcgccgccgggtggacccacacacgccaggagcaaactgcgcaggactcggccgccacctccctgcgcccctccaccgcggagaccctgcgcccctagcccagcgtctcttaccccacctgggcagcgctgcgtctgcggctcgtgggctccgggctcgcccgccgcggactctggctcaggtttcggctccggctggggccccggatccagctctggctctggcactgcacggttcttcggcccctgctggttcgctacatcccagcgcgcgaggccggggcttcctcggctcggcccgctcctcccgccgccgccgcccgtcgcccgcggggaaggcggggacactggccgggaggcgggaagggtggggggaggggaagctaggtgttcgccgggacctgcggggagaggggcggcgcgcagtcccgccggctaggggtcctggcctccctcggggcgtaggctggggtccgcgcggctggcggccgggcctcgaggccggggagcgcgccctgggacctccgtggaggggccctgccgcatgcggacgaagccagagcgggtcccagcctggccctggggcactttctctccctgggcccagtttcccacctgactcgtgaggggctggccctacttccgtttagacgggggctggtggtcgagtttggggtttt

SEQ ID NO: 124943 - DNA, 163 bp, Homo sapiens; identical to SEQ ID NO: 92924
  misc_feature 1..163: note = chr5:134376212-134376375
  misc_feature 1..163: note = Hyper
  source 1..163: mol_type = genomic DNA

SEQ ID NO: 124944 - DNA, 207 bp, Homo sapiens
  misc_feature 1..207: note = chr5:134376656-134376863
  misc_feature 1..207: note = Hyper
  source 1..207: mol_type = genomic DNA
ggcgtcctgctagtccgtgcctccagggccgcttggcctgggaacgcagagacccacgaccccctccccaacctccgaagcgggaagccggcccgacccaagctcacagaggcctcggtgttcaggccctgccaggtggcctctgcaccctgtcgtgctgttccagggactccataccctcctctcaaccctcgacagcaggaaccc

SEQ ID NO: 124945 - DNA, 494 bp, Homo sapiens
  misc_feature 1..494: note = chr5:134385889-134386383
  misc_feature 1..494: note = Hyper
  source 1..494: mol_type = genomic DNA
caccaggagctgtctcgggacctgggaagggcaggagggcgaggggctagggcgatggaagggggagatcaagagtggcgcggcagggggagagcgccctgagcctcgctggagcccatcccggcatggctgctgggaccgacaggccgatcgcgggccgcgagcacatctcacagagcctgggcacagagggcccgaactgtgcccagcgaggaggacgcgtgtgggttttgcctgcaagggttctgaccacttggggacagcgagggcgcgtagaggcgcggagctcactacgcgccgcctcactcttccgcgcgaggtgccgggtggcccagcagcaggtgctcgcgcgcaggtccagagcggcgcgttgcagagcccgctgtgccaccggagaaccgtggagcagccagggccgcactcgggcgtctgtccccagcctcatggttgccagcagagctggcgcaggggcgcgcaggcggtgagagcaatga

SEQ ID NO: 124946 - DNA, 120 bp, Homo sapiens; identical to SEQ ID NO: 92928
  misc_feature 1..120: note = chr5:134583042-134583162
  misc_feature 1..120: note = Hypo
  source 1..120: mol_type = genomic DNA

SEQ ID NO: 124947 - DNA, 109 bp, Homo sapiens; identical to SEQ ID NO: 92931
  misc_feature 1..109: note = chr5:134801812-134801921
  misc_feature 1..109: note = Hyper
  source 1..109: mol_type = genomic DNA

SEQ ID NO: 124948 - DNA, 144 bp, Homo sapiens; identical to SEQ ID NO: 92932
  misc_feature 1..144: note = chr5:134802222-134802366
  misc_feature 1..144: note = Hyper
  source 1..144: mol_type = genomic DNA

SEQ ID NO: 124949 - DNA, 89 bp, Homo sapiens; identical to SEQ ID NO: 92933
  misc_feature 1..89: note = chr5:134824488-134824577
  misc_feature 1..89: note = Hyper
  source 1..89: mol_type = genomic DNA

SEQ ID NO: 124950 - DNA, 30 bp, Homo sapiens; identical to SEQ ID NO: 92934
  misc_feature 1..30: note = chr5:134824825-134824855
  misc_feature 1..30: note = Hyper
  source 1..30: mol_type = genomic DNA

SEQ ID NO: 124951 - DNA, 56 bp, Homo sapiens
  misc_feature 1..56: note = chr5:134825103-134825159
  misc_feature 1..56: note = Hyper
  source 1..56: mol_type = genomic DNA
gggcgcctggccttgcgcgcctgttcccctgggagccacttcgtctccctgggtgt

SEQ ID NO: 124952 - DNA, 1126 bp, Homo sapiens
  misc_feature 1..1126: note = chr5:134825383-134826509
  misc_feature 1..1126: note = Hyper
  source 1..1126: mol_type = genomic DNA
tgtttaaaagggggccgagagcgagggcgcccaatctttgaactggtcgggttttgcatgcctccgctccgagcccgtggagcgctgcacaaaatcgtctagcgcggagcagggcggggacggggagagacacaaaacaatcctcgggctttctcgctactgagccttcggggccgtttccccaagcgcaaacagatgcaaatgtctctgcaaacattgcacaaagctattcagagagaggcagcctctcgcggcctcaatagccctttaaacctagtccaattgcccccaagtagaggtaaagagtccacatgcattttttcactttggctggaagaggggcggaggaggcgagggccttggggagcaaggtatgagggctgctctggttcagcggttcgtgccatcgacccgagctgcagcgtgcggaagaccggcaggagagtgcggtggctcgggggactacgcgcttcgggccgggcggggattgaggtgcagccgaagctggtgccgcgggaatgcgcggaccggagaggcccccgggacctttcaggcccacaaacgccgcgctaaatagccacgcgcacaatagcatgaaagggctcactcggaccttactgcaacacagtagattcacacccctccgaggggactaataagctcgtaactaacgcgcaacgctcagcggtgagagcgggcttgcgccctgctggcccctcgcagtacgcagactcagtctttcagcgtcactcggaggcccaagggcagccgctgcacggagggccaggcatttccttctaacctcgccagtagaggagcctggggcctgccggtgcagtccttaatgcaccccaaactcacgtggggctggcgaccccggaggctcggcatttcctggcccttcagaagacgatgtcgggacctctagactccaggctgagcgaggaagaagctccagtaaaagatgccagcgtaggcgcggtcttagccagctgtggccaagccgcctccacctccagttcagggccggggcctttcccgtcgccgcacgcagcaggtgctctggacgcgatgggcggcctagccagagcaggcacgtgcgctgagggcccggaaaagccccttc

SEQ ID NO: 124953 - DNA, 1717 bp, Homo sapiens
  misc_feature 1..1717: note = chr5:134870423-134872140
  misc_feature 1..1717: note = Hyper
  source 1..1717: mol_type = genomic DNA
tgcaaaaggaaaggccgtctaggggcgggcaggaggggcgctgggctgagggccggagaaacagaccaagagacatccgccgcgagggtgcggcgacctaacaagcggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggctactggggtcagagagcggggaggcggcggcggcacctgagccccaggactccgcgtcgctggcggggcttgggggaccgggcaggcaggggacgcactgcggcggcaggaggcgctcccgggcaccgcctccgggcagcccttgatccgccaggcgcagtgtctcggccagagcccagatgtagttgtaggcgaagcgcagcgtctcgattttggtgagcttggtgtcgtcggggaacgagggcagcacgctgcgcagtgcgtccagggccgcgttcaagttgtgcatgcggttgcgctcgcgatcgttggccttgacgcgccggctcctgcgcagcgagtgcagcagcgcctcggagcggacccgcgtccggccgcggcgccgccgcctctcctgctcgtcgtcctgtgcccctggaacctcagacgcccgggagatattgggcgcgcccctgcgggccggcgcgggcggccccgaagcggaggctgcctgttggagtctggcacagtcttcctcgtcggtgaggaagccggataggtcactgccgctgctgctggcgcagtcgaggtcggagatgcaggtctcaaggcgggctggcatcgttgcgctgtgcaggaccgacggacagatagaaaggcgctcagagcgctgcagcccggactgagggcagagccgccagggcgcacttacgttcccaacagcctggggttgttactctgtgccagttgcgggtgcgagagcctggaagggtgcaggggcgcacggagaacttggcctggcctcctcgcctcgcctgcaggggccacgcgcccggccggtctcctgagtgatgtcgccggcgatcagatcagctcgtgtgagcaccgagtgtggcacacgactggcctcaggaccccttaagtacccggcgcaacaatgggcgcccccctcccttgccacctccgcccccgcggcagcccgggtgaatggagcgaggcggcaggtcatccccgtgcagcgcccgggtatttgcataatttatgctcgcgggaggccgccatcgcccctcccccaacccggagtgtgcccgtaattaccgccggccaatcggcggcgtcgcgcggccccgggagtcggctcgggctaagctggccagggcgtctccaggcagtgaaacagaggcggggtcggcgggcgattagcggccgaggcacgctcctcttggggcgggctgggcgcccctcgctggggtgggacggggaggcggggcgcgagcgcgaaagtgtgagccgcccagtgagttgcggaaacctggagggtacttggagtttgggttcgcatcccctctccagctgcttagtggtcgcgtgactttggacga

SEQ ID NO: 124954 - DNA, 702 bp, Homo sapiens; identical to SEQ ID NO: 92941
  misc_feature 1..702: note = chr5:134879271-134879973
  misc_feature 1..702: note = Hyper
  source 1..702: mol_type = genomic DNA

SEQ ID NO: 124955 - DNA, 461 bp, Homo sapiens
  misc_feature 1..461: note = chr5:134880153-134880614
  misc_feature 1..461: note = Hyper
  source 1..461: mol_type = genomic DNA
ccggaagagctgggatggagaataaggatgaattctggagggaaatccggcaaaacgggcattggcactaaaataggacattcgttaaggaaacaacaaagatggctgaagaatggagtatggctgaaaaaagcccactggagaggtgcagatagtcccctctgggcgccttccgaggttgggagggcattctggcccccgcccctccccgccgcaatctgtcgggacccgccgggtttccatatgaagggtcgagccggcgccttgggagcgctgaatggccgctcgcggtccggcgggcgcgcacgccccgcggcccgggctggatttggccgcatttgcatagcaggtgctgatgcttgtccattcttacttaaagaagttttaatatgggataaattaccaggaactaggagctgacgtgggcgggaaaaaaggaatcgtgtcgccagccagtcttc

SEQ ID NO: 124956 - DNA, 885 bp, Homo sapiens; identical to SEQ ID NO: 92943
  misc_feature 1..885: note = chr5:134914192-134915077
  misc_feature 1..885: note = Hyper
  source 1..885: mol_type = genomic DNA

SEQ ID NO: 124957 - DNA, 290 bp, Homo sapiens; identical to SEQ ID NO: 29911
  misc_feature 1..290: note = chr5:135170256-135170546
  misc_feature 1..290: note = Hyper
  source 1..290: mol_type = genomic DNA

SEQ ID NO: 124958 - DNA, 278 bp, Homo sapiens; identical to SEQ ID NO: 92945
  misc_feature 1..278: note = chr5:135170915-135171193
  misc_feature 1..278: note = Hyper
  source 1..278: mol_type = genomic DNA

SEQ ID NO: 124959 - DNA, 1004 bp, Homo sapiens
  misc_feature 1..1004: note = chr5:135265701-135266705
  misc_feature 1..1004: note = Hyper
  source 1..1004: mol_type = genomic DNA
gcattgataaaggggcgcccttcatcgggagtaagtcccagaaaccacaagcgttggctcatgcctgtgtggagtcacaggcaggtggccacggggaattagctgaagaccagcaggcaggaagcctcccacatgccacctaaggggcgctcccggaaccgccgcccctgcgggaggagcggctggggtctcagatcgccgtgcgtgacttggtgctgcgccaggtgggcgccatcgccgcggcctgctgggggaggcggcctttgaggagcgggcgcgaggcggggccaggcggggcggggccttgggcggctgcggtctgcgcggacccccgtgcctaggcgctcctgtgcctccagtgcgcggagccggcctcgctcgggcgtgttcctgcgccgaccggacggccggactccagcaccttggcccggcccgcgaacgctgagcacgcgcggaaaccctttaaaggtagcacatttttcgggtgtcgcgggggcaccgccggcggtggcgacgtggggcggaatgggctcgctctttgggcccgggaggcgtgcgctcgcgccctgggccacgtcggggcggtctcgggcggctgagcgccccctggagcgacccctcccgcggcccgggcccggccgcccccgaagccggggtgagcggggcctggctcgggccgccagtgaggactcgcagcccccgggcgtccgctttctcgctgggctgggtttctgcagtgccgggcgcccacccggccaccccatgagccgcgcgtctggctcttcggtggagtgagcctagaaagggcggcgttcgtccagtgatcagtgctacccgaggttgctttttgcatgactgcttgcagttaagttcaccggagtttatagttgccacaaatgtcaaaaagtagccttctggcgagctgaaagcgctcacctgtgcgctttaaggtgtaccgtctttgtctttggcgagtgtgccttttaagacgcttccaagataaa

SEQ ID NO: 124960 - DNA, 53 bp, Homo sapiens; identical to SEQ ID NO: 92950
  misc_feature 1..53: note = chr5:135364596-135364649
  misc_feature 1..53: note = Hyper
  source 1..53: mol_type = genomic DNA

SEQ ID NO: 124961 - DNA, 1088 bp, Homo sapiens; identical to SEQ ID NO: 92951
  misc_feature 1..1088: note = chr5:135527803-135528891
  misc_feature 1..1088: note = Hyper
  source 1..1088: mol_type = genomic DNA

SEQ ID NO: 124962 - DNA, 1133 bp, Homo sapiens
  misc_feature 1..1133: note = chr5:136834011-136835144
  misc_feature 1..1133: note = Hyper
  source 1..1133: mol_type = genomic DNA
ccctccgagaggctccgcgccccccagggccgggtggcgccggtactcacgtctcgaaagcggttccagtacttgtcccggtcgtactgggagacggtgctcagccactggtcattgtctaggaaattgccgtggttggggcccgcgcctccggcgagcgcgtccaggtgccggctctcgacttggaggaagcaccacgccgcggcggccgccgccaacaccgcgatcgccggcatctgcggggcagggcgcgcagggcgatgagcgaagagggcgggcggccgcgagccccgggcacccaggcgtcccagcgccccagcccggaggcggggaccccgcggcgggcacgggcagcgctcgcgcacctggggcgcctgtcgcgcctctagacccagggacccctctcacgaatgggggactcatctacgaacgaggaggctgcgtcacgaatccgaggctgccgtccaactacaggggacccgtctcgtctattctccgagtgccccacagatgccgccctcctatcaggggcttggtacccctccccagaagcggggagcccgggtccgcacgccgcactcccacagacggtgcggtgcacacggctttggggcaggagaggggagaacagggctccagcagcacccgagctccggcaagcggggtgggggctgccagcagctgggggtccccggcgacagctaagggaaaggtctcccttgagcgccctgaggtctcgggggtaagaaaggcgcgcggaggtaaccccaggccctgaccctgccagccccctaggcggccgcggggaggtcccaactactccaagttggggcgcggggttcctctgggcacgtaccttgggggccggcccgggtcccctagtccgagttgctcgagctcccgcggcacggtcgccgggaaggctgatcgccggctcgcgcccctgcgctcctgccacacgccgccgccgagcgtctggccgctttgtgagcccgcagcgatgtgctctgctcgctcgctggctcgggcgcggcgtccgcgggcggaggaggccgagcgcgcgagccaaggctctggcgccccctggtggccgcgcgctgcctgcccgacagcccggccgccccagcccggaa

SEQ ID NO: 124963 - DNA, 99 bp, Homo sapiens
  misc_feature 1..99: note = chr5:137225068-137225167
  misc_feature 1..99: note = Hyper
  source 1..99: mol_type = genomic DNA
gaggagctgggggctcgcgcaggcgtcagagccgggcagcgcgcgccgcaagactagcgcgcaagcgccgcggcctcaggcgaacgaacgggcggtgta

SEQ ID NO: 124964 - DNA, 30 bp, Homo sapiens; identical to SEQ ID NO: 92961
  misc_feature 1..30: note = chr5:137474889-137474919
  misc_feature 1..30: note = Hyper
  source 1..30: mol_type = genomic DNA

SEQ ID NO: 124965 - DNA, 26 bp, Homo sapiens
  misc_feature 1..26: note = chr5:137548023-137548049
  misc_feature 1..26: note = Hypo
  source 1..26: mol_type = genomic DNA
tttgagacagtgtcccgctctgccct

SEQ ID NO: 124966 - DNA, 412 bp, Homo sapiens; identical to SEQ ID NO: 92963
  misc_feature 1..412: note = chr5:137577572-137577984
  misc_feature 1..412: note = Hyper
  source 1..412: mol_type = genomic DNA

SEQ ID NO: 124967 - DNA, 51 bp, Homo sapiens; identical to SEQ ID NO: 92964
  misc_feature 1..51: note = chr5:137727606-137727657
  misc_feature 1..51: note = Hypo
  source 1..51: mol_type = genomic DNA

SEQ ID NO: 124968 - DNA, 23 bp, Homo sapiens
  misc_feature 1..23: note = chr5:137769715-137769738
  misc_feature 1..23: note = Hypo
  source 1..23: mol_type = genomic DNA
accgtgcccgtccaacattggtg

SEQ ID NO: 124969 - DNA, 30 bp, Homo sapiens; identical to SEQ ID NO: 92967
  misc_feature 1..30: note = chr5:138060847-138060877
  misc_feature 1..30: note = Hypo
  source 1..30: mol_type = genomic DNA

SEQ ID NO: 124970 - DNA, 122 bp, Homo sapiens; identical to SEQ ID NO: 92970
  misc_feature 1..122: note = chr5:138273634-138273756
  misc_feature 1..122: note = Hypo
  source 1..122: mol_type = genomic DNA

SEQ ID NO: 124971 - DNA, 55 bp, Homo sapiens; identical to SEQ ID NO: 92972
  misc_feature 1..55: note = chr5:138586687-138586742
  misc_feature 1..55: note = Hypo
  source 1..55: mol_type = genomic DNA

SEQ ID NO: 124972 - DNA, 95 bp, Homo sapiens; identical to SEQ ID NO: 92973
  misc_feature 1..95: note = chr5:138627655-138627750
  misc_feature 1..95: note = Hypo
  source 1..95: mol_type = genomic DNA

SEQ ID NO: 124973 - DNA, 30 bp, Homo sapiens; identical to SEQ ID NO: 92974
  misc_feature 1..30: note = chr5:138670672-138670702
  misc_feature 1..30: note = Hypo
  source 1..30: mol_type = genomic DNA

SEQ ID NO: 124974 - DNA, 143 bp, Homo sapiens; identical to SEQ ID NO: 92975
  misc_feature 1..143: note = chr5:138676299-138676442
  misc_feature 1..143: note = Hypo
  source 1..143: mol_type = genomic DNA

SEQ ID NO: 124975 - DNA, 37 bp, Homo sapiens; identical to SEQ ID NO: 92976
  misc_feature 1..37: note = chr5:138679633-138679670
  misc_feature 1..37: note = Hypo
  source 1..37: mol_type = genomic DNA

SEQ ID NO: 124976 - DNA, 24 bp, Homo sapiens
  misc_feature 1..24: note = chr5:138971490-138971514
  misc_feature 1..24: note = Hypo
  source 1..24: mol_type = genomic DNA
ttgaaaacctggggccgggcgcgg

SEQ ID NO: 124977 - DNA, 309 bp, Homo sapiens; identical to SEQ ID NO: 92978
  misc_feature 1..309: note = chr5:139047939-139048248
  misc_feature 1..309: note = Hyper
  source 1..309: mol_type = genomic DNA

SEQ ID NO: 124978 - DNA, 32 bp, Homo sapiens; identical to SEQ ID NO: 92979
  misc_feature 1..32: note = chr5:139090340-139090372
  misc_feature 1..32: note = Hyper
  source 1..32: mol_type = genomic DNA

SEQ ID NO: 124979 - DNA, 172 bp, Homo sapiens; identical to SEQ ID NO: 92980
  misc_feature 1..172: note = chr5:139142327-139142499
  misc_feature 1..172: note = Hypo
  source 1..172: mol_type = genomic DNA

SEQ ID NO: 124980 - DNA, 194 bp, Homo sapiens
  misc_feature 1..194: note = chr5:139144062-139144256
  misc_feature 1..194: note = Hyper
  source 1..194: mol_type = genomic DNA
gcagcctggcgcgcccgctccctggggtccccgccgagcgcctgcctggctgcgggaccccgttgccaggagcagtcaggatgcggcagcgtctccatggcaacgcggcatctcgagccgcgcgccgccctcccccggcgccccgcagtgggcaggaggccgagcctggcagcccctcccggcccagcagccag

SEQ ID NO: 124981 - DNA, 577 bp, Homo sapiens
  misc_feature 1..577: note = chr5:139175410-139175987
  misc_feature 1..577: note = Hyper
  source 1..577: mol_type = genomic DNA
tcagcctctccacatcgcggctccggcacctgaagggacgcgggcgggcgcgggcagctccgaccggcggcggcggggcgggacaggcagcccggcggcctccgatggccccgccgtgagaggccggacccgcggcggggaccagcagcggtgagtggggccgcggggctccgggacccgcccctccccgctggcggccaggccggggcgggacgggccggggagagggccgcgtgcgggtggggggcgtcgccctcgccctcggtgcccacccgggtccgctaacaaagctacatttccagatcaattccgcggcgtctggagcatccgaaggatacggttgtcatggagatggggccgagagaggaagcccgggctggccgggtctgggccggggagagggggcgccgcgggaaagcccgagcccagcctgagggacggtgggggctgccgggccgattgtctcccggctccgccacccactaccctctccccgcttttgtataatctgggggtacgcgtgtgcgtggggggtgccagtggcagcctggtggtcggggatcggggcattgggtac

SEQ ID NO: 124982 - DNA, 411 bp, Homo sapiens
  misc_feature 1..411: note = chr5:139227527-139227938
  misc_feature 1..411: note = Hyper
  source 1..411: mol_type = genomic DNA
cccgcgggggcggcccgcggctgtgtctgctgctggcccgcgtgctgtggctgtccagtgagtagtaagtcctgctgtcggccgccgggcacagtggcggcgagtccgagcgcagcgcgtcgtgcgccccacgcaggcccaggaaaggtgtgctctcggccgccagcgccccgtccgcgtcgtccgcgtcgtcgtccgacgccgaggctgagccgccgcccgagccgctgctcagcgacagcgagtccctcgccgcccgtgcgcgctgcgccgccagcccgttgaggcgcgagcggcgccagcgccggggccccgccgacgtcctgcgggacgcaccgcgcgcgcgcggccgcggcggcggcgggggcgcgcactcctgcgtggtctcgtactcgtcgtcctcggggatgc

SEQ ID NO: 124983 - DNA, 913 bp, Homo sapiens; identical to SEQ ID NO: 92986
  misc_feature 1..913: note = chr5:139283550-139284463
  misc_feature 1..913: note = Hyper
  source 1..913: mol_type = genomic DNA

SEQ ID NO: 124984 - DNA, 62 bp, Homo sapiens; identical to SEQ ID NO: 92987
  misc_feature 1..62: note = chr5:139422801-139422863
  misc_feature 1..62: note = Hyper
  source 1..62: mol_type = genomic DNA

SEQ ID NO: 124985 - DNA, 70 bp, Homo sapiens; identical to SEQ ID NO: 92988
  misc_feature 1..70: note = chr5:139492746-139492816
  misc_feature 1..70: note = Hyper
  source 1..70: mol_type = genomic DNA

SEQ ID NO: 124986 - DNA, 391 bp, Homo sapiens; identical to SEQ ID NO: 92989
  misc_feature 1..391: note = chr5:139525423-139525814
  misc_feature 1..391: note = Hyper
  source 1..391: mol_type = genomic DNA

SEQ ID NO: 124987 - DNA, 97 bp, Homo sapiens; identical to SEQ ID NO: 92990
  misc_feature 1..97: note = chr5:139556302-139556399
  misc_feature 1..97: note = Hypo
  source 1..97: mol_type = genomic DNA

SEQ ID NO: 124988 - DNA, 32 bp, Homo sapiens; identical to SEQ ID NO: 92992
  misc_feature 1..32: note = chr5:139779839-139779871
  misc_feature 1..32: note = Hypo
  source 1..32: mol_type = genomic DNA

SEQ ID NO: 124989 - DNA, 48 bp, Homo sapiens; identical to SEQ ID NO: 92994
  misc_feature 1..48: note = chr5:140011748-140011796
  misc_feature 1..48: note = Hyper
  source 1..48: mol_type = genomic DNA

SEQ ID NO: 124990 - DNA, 369 bp, Homo sapiens
  misc_feature 1..369: note = chr5:140012151-140012520
  misc_feature 1..369: note = Hyper
  source 1..369: mol_type = genomic DNA
ggcttccagaggcagcggaggcatggtgccggttatctttaggtcctcgagcgtcagttccttgaggcgggagtacgctagcacacgcagggcgcctaccagtagctgagcaggaacctgtgcggctcccactgtgagccgccgcacgcggagagccttgaccgtgtcagcatactgccgcgggtcggcgtccgcatcgacgcgctttagaaacggctctaggttgagaccgccggcatggatctccacctctactgcagacacacactggaaggcttcggaccagtcgggctgaggttcggagaagttgcagacgcagcggaaatcttcatcgtccagctcacaaggttctggcgtggtcgcagagac

SEQ ID NO: 124991 - DNA, 27 bp, Homo sapiens
  misc_feature 1..27: note = chr5:140045321-140045348
  misc_feature 1..27: note = Hypo
  source 1..27: mol_type = genomic DNA
cacgcctgtaatacccgcactttggga

SEQ ID NO: 124992 - DNA, 30 bp, Homo sapiens; identical to SEQ ID NO: 92998
  misc_feature 1..30: note = chr5:140088640-140088670
  misc_feature 1..30: note = Hypo
  source 1..30: mol_type = genomic DNA

SEQ ID NO: 124993 - DNA, 175 bp, Homo sapiens
  misc_feature 1..175: note = chr5:140174726-140174901
  misc_feature 1..175: note = Hyper
  source 1..175: mol_type = genomic DNA
gtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttcc

SEQ ID NO: 124994 - DNA, 198 bp, Homo sapiens; identical to SEQ ID NO: 93000
  misc_feature 1..198: note = chr5:140187083-140187281
  misc_feature 1..198: note = Hyper
  source 1..198: mol_type = genomic DNA

SEQ ID NO: 124995 - DNA, 55 bp, Homo sapiens; identical to SEQ ID NO: 93001
  misc_feature 1..55: note = chr5:140214378-140214433
  misc_feature 1..55: note = Hyper
  source 1..55: mol_type = genomic DNA

SEQ ID NO: 124996 - DNA, 116 bp, Homo sapiens; identical to SEQ ID NO: 93002
  misc_feature 1..116: note = chr5:140248756-140248872
  misc_feature 1..116: note = Hyper
  source 1..116: mol_type = genomic DNA

SEQ ID NO: 124997 - DNA, 142 bp, Homo sapiens; identical to SEQ ID NO: 93003
  misc_feature 1..142: note = chr5:140261869-140262011
  misc_feature 1..142: note = Hyper
  source 1..142: mol_type = genomic DNA

SEQ ID NO: 124998 - DNA, 1705 bp, Homo sapiens
  misc_feature 1..1705: note = chr5:140305402-140307107
  misc_feature 1..1705: note = Hyper
  source 1..1705: mol_type = genomic DNA
tctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggcta

SEQ ID NO: 124999 - DNA, 537 bp, Homo sapiens; identical to SEQ ID NO: 93008
  misc_feature 1..537: note = chr5:140345497-140346034
  misc_feature 1..537: note = Hyper
  source 1..537: mol_type = genomic DNA

SEQ ID NO: 125000 - DNA, 307 bp, Homo sapiens; identical to SEQ ID NO: 93009
  misc_feature 1..307: note = chr5:140346506-140346813
  misc_feature 1..307: note = Hyper
  source 1..307: mol_type = genomic DNA

SEQ ID NO: 125001 - DNA, 30 bp, Homo sapiens; identical to SEQ ID NO: 93011
  misc_feature 1..30: note = chr5:140464113-140464143
  misc_feature 1..30: note = Hyper
  source 1..30: mol_type = genomic DNA

SEQ ID NO: 125002 - DNA, 30 bp, Homo sapiens; identical to SEQ ID NO: 93012
  misc_feature 1..30: note = chr5:140474232-140474262
  misc_feature 1..30: note = Hyper
  source 1..30: mol_type = genomic DNA

SEQ ID NO: 125003 - DNA, 261 bp, Homo sapiens; identical to SEQ ID NO: 93013
  misc_feature 1..261: note = chr5:140514695-140514956
  misc_feature 1..261: note = Hyper
  source 1..261: mol_type = genomic DNA

SEQ ID NO: 125004 - DNA, 93 bp, Homo sapiens; identical to SEQ ID NO: 93014
  misc_feature 1..93: note = chr5:140581545-140581638
  misc_feature 1..93: note = Hyper
  source 1..93: mol_type = genomic DNA

SEQ ID NO: 125005 - DNA, 182 bp, Homo sapiens; identical to SEQ ID NO: 29948
  misc_feature 1..182: note = chr5:140593316-140593498
  misc_feature 1..182: note = Hyper
  source 1..182: mol_type = genomic DNA

SEQ ID NO: 125006 - DNA, 75 bp, Homo sapiens; identical to SEQ ID NO: 29949
  misc_feature 1..75: note = chr5:140604438-140604513
  misc_feature 1..75: note = Hyper
  source 1..75: mol_type = genomic DNA

SEQ ID NO: 125007 - DNA, 210 bp, Homo sapiens; identical to SEQ ID NO: 93017
  misc_feature 1..210: note = chr5:140613804-140614014
  misc_feature 1..210: note = Hyper
  source 1..210: mol_type = genomic DNA

SEQ ID NO: 125008 - DNA, 97 bp, Homo sapiens
  misc_feature 1..97: note = chr5:140614314-140614411
  misc_feature 1..97: note = Hyper
  source 1..97: mol_type = genomic DNA
cagagtcatctttgacgactataaaccttatttgcgattggatccacagaatggcgacttgctcttaaacgagcagctggaccgggaggcactttgt

SEQ ID NO: 125009 - DNA, 23 bp, Homo sapiens
  misc_feature 1..23: note = chr5:140620855-140620878
  misc_feature 1..23: note = Hyper
  source 1..23: mol_type = genomic DNA
caccctgttcgtccgcgagaaca

SEQ ID NO: 125010 - DNA, 70 bp, Homo sapiens
  misc_feature 1..70: note = chr5:140624988-140625058
  misc_feature 1..70: note = Hyper
  source 1..70: mol_type = genomic DNA
cctgttagcagagcacggaccagtgtctccggagaatgctattctcctacatttccgaacaggttatcaa

SEQ ID NO: 125011 - DNA, 120 bp, Homo sapiens; identical to SEQ ID NO: 93023
  misc_feature 1..120: note = chr5:140713966-140714086
  misc_feature 1..120: note = Hyper
  source 1..120: mol_type = genomic DNA

SEQ ID NO: 125012 - DNA, 19 bp, Homo sapiens
  misc_feature 1..19: note = chr5:140714146-140714165
  misc_feature 1..19: note = Hyper
  source 1..19: mol_type = genomic DNA
tgggcgacagagccacacc

SEQ ID NO: 125013 - DNA, 95 bp, Homo sapiens; identical to SEQ ID NO: 93025
  misc_feature 1..95: note = chr5:140767211-140767306
  misc_feature 1..95: note = Hyper
  source 1..95: mol_type = genomic DNA

SEQ ID NO: 125014 - DNA, 212 bp, Homo sapiens; identical to SEQ ID NO: 93026
  misc_feature 1..212: note = chr5:140777457-140777669
  misc_feature 1..212: note = Hyper
  source 1..212: mol_type = genomic DNA

SEQ ID NO: 125015 - DNA, 85 bp, Homo sapiens; identical to SEQ ID NO: 29956
  misc_feature 1..85: note = chr5:140787848-140787933
  misc_feature 1..85: note = Hyper
  source 1..85: mol_type = genomic DNA

SEQ ID NO: 125016 - DNA, 563 bp, Homo sapiens
  misc_feature 1..563: note = chr5:140797076-140797639
  misc_feature 1..563: note = Hyper
  source 1..563: mol_type = genomic DNA
ttttggctgtcaactcgtagtttaaaaaaaattccttgaaagaggtagagaaaagtcaagttgcagtcccacacagagcctctgggcgccgccgtcggccagtgcagagcaagcgctgacgccggggatccctcagcctctagcctgggattccctgcgcagccaacaacagaaaagaaaaccagctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggag

SEQ ID NO: 125017 - DNA, 825 bp, Homo sapiens
  misc_feature 1..825: note = chr5:140800437-140801262
  misc_feature 1..825: note = Hyper
  source 1..825: mol_type = genomic DNA
agtattgtgtatcatcgtttttaagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcct

SEQ ID NO: 125018 - DNA, 88 bp, Homo sapiens
  misc_feature 1..88: note = chr5:140810974-140811062
  misc_feature 1..88: note = Hyper
  source 1..88: mol_type = genomic DNA
gggggcgacccggtgcgcacaggcaccgcgcgcatccgcgtgatggttctggatgcgaacgacaacgcaccagcgtttgctcagcccg

SEQ ID NO: 125019 - DNA, 1092 bp, Homo sapiens
  misc_feature 1..1092: note = chr5:140855598-140856690
  misc_feature 1..1092: note = Hyper
  source 1..1092: mol_type = genomic DNA
gcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattg

SEQ ID NO: 125020 - DNA, 138 bp, Homo sapiens
  misc_feature 1..138: note = chr5:140864562-140864700
  misc_feature 1..138: note = Hyper
  source 1..138: mol_type = genomic DNA
cagacaaatctaccccgccaccagcaaaaacggcgcgtaacccttgcggcgccggccgaaccgcgccagagctggcgcggggaaagggagataggtgtctccagctgctgtggctgtttggggcgggtcggcttcatc

SEQ ID NO: 125021 - DNA, 60 bp, Homo sapiens
  misc_feature 1..60: note = chr5:140871515-140871575
  misc_feature 1..60: note = Hyper
  source 1..60: mol_type = genomic DNA
acactcaaaaaaggccggggcctccttcgagcttccggtgaatttcgggcgatttccgcg

SEQ ID NO: 125022 - DNA, 30 bp, Homo sapiens; identical to SEQ ID NO: 93036
  misc_feature 1..30: note = chr5:140892846-140892876
  misc_feature 1..30: note = Hyper
  source 1..30: mol_type = genomic DNA

SEQ ID NO: 125023 - DNA, 77 bp, Homo sapiens; identical to SEQ ID NO: 93037
  misc_feature 1..77: note = chr5:141030807-141030884
  misc_feature 1..77: note = Hyper
  source 1..77: mol_type = genomic DNA

SEQ ID NO: 125024 - DNA, 30 bp, Homo sapiens; identical to SEQ ID NO: 93038
  misc_feature 1..30: note = chr5:141031100-141031130
  misc_feature 1..30: note = Hyper
  source 1..30: mol_type = genomic DNA

SEQ ID NO: 125025 - DNA, 33 bp, Homo sapiens; identical to SEQ ID NO: 93040
  misc_feature 1..33: note = chr5:141255658-141255691
  misc_feature 1..33: note = Hyper
  source 1..33: mol_type = genomic DNA

SEQ ID NO: 125026 - DNA, 605 bp, Homo sapiens
  misc_feature 1..605: note = chr5:141262718-141263323
  misc_feature 1..605: note = Hyper
  source 1..605: mol_type = genomic DNA
aattcctttcttccccgaagagctccccactctccctgaccagagtctccttgatctggaggctgggcagcccccggggacccggtggccgccgctgaccccgtggcatgcggctctcaaaggccccattcatctctgggggctgaaggcgccattgtccccagcggggggtggtgtggggagtgaaggggtctggactcagaaggaaggaatgcgtctggagaagttgcccccggggctccagtctcaaggtccccaccagatctccatcgggaccctttcacgaccccgagccctttccccaggagctcccagcaaccttcgcgcttctccggagggtggggtctgccgcggcgcgggggcagcctcaccccacctcactgctggactccggagaaccatttctgggaccgggagctgtccagcgcctcgggtcctgacggaccgctgattcgcctaggtgccatcggacaagcgggtgctcagagccagctctggtggctcgggagctttcccccaaccaggctaagaccactaaaccacgcctggcccggatgagcttggatgcagctccgaacgtggggatccatcggtgctgagaactg

SEQ ID NO: 125027 - DNA, 345 bp, Homo sapiens; identical to SEQ ID NO: 93043
  misc_feature 1..345: note = chr5:141293717-141294062
  misc_feature 1..345: note = Hyper
  source 1..345: mol_type = genomic DNA

SEQ ID NO: 125028 - DNA, 40 bp, Homo sapiens; identical to SEQ ID NO: 93044
  misc_feature 1..40: note = chr5:141302337-141302377
  misc_feature 1..40: note = Hypo
  source 1..40: mol_type = genomic DNA

SEQ ID NO: 125029 - DNA, 30 bp, Homo sapiens; identical to SEQ ID NO: 93046
  misc_feature 1..30: note = chr5:141477290-141477320
  misc_feature 1..30: note = Hypo
  source 1..30: mol_type = genomic DNA

SEQ ID NO: 125030 - DNA, 79 bp, Homo sapiens; identical to SEQ ID NO: 93047
  misc_feature 1..79: note = chr5:141703865-141703944
  misc_feature 1..79: note = Hyper
  source 1..79: mol_type = genomic DNA

SEQ ID NO: 125031 - DNA, 197 bp, Homo sapiens
  misc_feature 1..197: note = chr5:141931306-141931503
  misc_feature 1..197: note = Hyper
  source 1..197: mol_type = genomic DNA
aaatgtgctcattcccgaggaagcctcacttctccttctcgcccttaatcgctcctttcctgcccgccccagcccccaggctgggcgatttcctaaatcactcggaattggcttccagcgccggcgccccgggtgggctcccggagcgcgcgggcctgtgacccggaggtcagagatgcctccgtcctgtttgatgt

SEQ ID NO: 125032 - DNA, 95 bp, Homo sapiens; identical to SEQ ID NO: 40602
  misc_feature 1..95: note = chr5:142070580-142070675
  misc_feature 1..95: note = Hypo
  source 1..95: mol_type = genomic DNA

SEQ ID NO: 125033 - DNA, 158 bp, Homo sapiens; identical to SEQ ID NO: 40603
  misc_feature 1..158: note = chr5:142625575-142625733
  misc_feature 1..158: note = Hypo
  source 1..158: mol_type = genomic DNA

SEQ ID NO: 125034 - DNA, 30 bp, Homo sapiens; identical to SEQ ID NO: 93053
  misc_feature 1..30: note = chr5:142638926-142638956
  misc_feature 1..30: note = Hypo
  source 1..30: mol_type = genomic DNA

SEQ ID NO: 125035 - DNA, 30 bp, Homo sapiens; identical to SEQ ID NO: 40604
  misc_feature 1..30: note = chr5:142689842-142689872
  misc_feature 1..30: note = Hypo
  source 1..30: mol_type = genomic DNA

SEQ ID NO: 125036 - DNA, 30 bp, Homo sapiens; identical to SEQ ID NO: 93055
  misc_feature 1..30: note = chr5:142751146-142751176
  misc_feature 1..30: note = Hypo
  source 1..30: mol_type = genomic DNA

SEQ ID NO: 125037 - DNA, 155 bp, Homo sapiens; identical to SEQ ID NO: 29969
  misc_feature 1..155: note = chr5:142781720-142781875
  misc_feature 1..155: note = Hyper
  source 1..155: mol_type = genomic DNA

SEQ ID NO: 125038 - DNA, 540 bp, Homo sapiens; identical to SEQ ID NO: 93057
  misc_feature 1..540: note = chr5:142784675-142785215
  misc_feature 1..540: note = Hyper
  source 1..540: mol_type = genomic DNA

SEQ ID NO: 125039 - DNA, 287 bp, Homo sapiens; identical to SEQ ID NO: 29971
  misc_feature 1..287: note = chr5:143584834-143585121
  misc_feature 1..287: note = Hyper
  source 1..287: mol_type = genomic DNA

SEQ ID NO: 125040 - DNA, 289 bp, Homo sapiens; identical to SEQ ID NO: 93071
  misc_feature 1..289: note = chr5:145214863-145215152
  misc_feature 1..289: note = Hyper
  source 1..289: mol_type = genomic DNA

SEQ ID NO: 125041 - DNA, 21 bp, Homo sapiens
  misc_feature 1..21: note = chr5:145237564-145237585
  misc_feature 1..21: note = Hypo
  source 1..21: mol_type = genomic DNA
acggaatattcctgtcgaaaa

SEQ ID NO: 125042 - DNA, 141 bp, Homo sapiens; identical to SEQ ID NO: 93073
  misc_feature 1..141: note = chr5:145316085-145316226
  misc_feature 1..141: note = Hyper
  source 1..141: mol_type = genomic DNA

SEQ ID NO: 125043 - DNA, 304 bp, Homo sapiens
  misc_feature 1..304: note = chr5:145713592-145713896
  misc_feature 1..304: note = Hyper
  source 1..304: mol_type = genomic DNA
ggctgtgtccatggcggggcatctagggggaaggggagggctcctggcacgtgccgagccctcacggacgctcggcctctggcccctgaatccctctgggcgtctcggatcctctgagccactttgcagacaatgcaaggcagcggccaacagacgagtcccgcagcagctgcgcaggcggcgagtacatgtgagaagtttgtgaaaggcgaccagagaaagggagaggaaggcaagtcaggcggctgcgaacacctggccaggcagccccgccagctgcctcgctgcgcgatggcatcttgag

SEQ ID NO: 125044 - DNA, 557 bp, Homo sapiens
  misc_feature 1..557: note = chr5:145716880-145717437
  misc_feature 1..557: note = Hyper
  source 1..557: mol_type = genomic DNA
attccatttaagagccgccgaaaccgaggctcagagggctttagcgaaagggttgcgcttggctctaggcacctgggctgagtctttttcccaccatcgcagggcgggaaccagcggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggtgaggtctctaagccccgaagatcgctctctcagcggaggcagtggccctgacgagggggtacagctgcacgcgcggggtttctctccgaaccggagtgcagcgtagtcgaggtccaggattccccatccattattcacgatgtttactagagcggggcaagggagaggaaagaagagggaagtagagagaaaaagaggctaggggaggtggaggcgggcagtgctaacctcgagagccctcaagttccgaaactttgagaag

SEQ ID NO: 125045 - DNA, 265 bp, Homo sapiens; identical to SEQ ID NO: 29977
  misc_feature 1..265: note = chr5:145717780-145718045
  misc_feature 1..265: note = Hyper
  source 1..265: mol_type = genomic DNA

SEQ ID NO: 125046 - DNA, 70 bp, Homo sapiens; identical to SEQ ID NO: 93078
  misc_feature 1..70: note = chr5:145718431-145718501
  misc_feature 1..70: note = Hyper
  source 1..70: mol_type = genomic DNA

SEQ ID NO: 125047 - DNA, 1562 bp, Homo sapiens
  misc_feature 1..1562: note = chr5:145718802-145720364
  misc_feature 1..1562: note = Hyper
  source 1..1562: mol_type = genomic DNA
gtggagcataattaccgctctaaggcacattttttgacaggcactagcttcatgtttttttcatgtcgcccagaacaatcgccgctgtctgaacccctctccttgtctcccccgcgttctctcccggcgcgctctctctctcattcatgtctctgatccacacgtctgttccagcagagccgctgcctccgtattaatttttatgacctgggctttgaggagaggcatctcggttgcttgaaaatgtgttttaatcctgtgttgacagtattccctactgaccgtgctgtgcgccttctcgcttgcagctgcagggtaatatatttggaagctttgatgagagcctgctggcacgcgccgaagctctggcggcggtggatatcgtctcccacggcaagaaccatccgttcaagcccgacgccacctaccataccatgagcagcgtgccctgcacgtccacttcgtccaccgtgcccatctcccacccagctgcgctcacctcacaccctcaccacgccgtgcaccagggcctcgaaggcgacctgctggagcacatctcgcccacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggggtgacccaggcggacgtgggcgcggctctggctaatctcaagatccccggcgtgggctcgctgagccaaagcaccatctgcaggttcgagtctctcactctctcgcacaacaacatgatcgctctcaagccggtgctccaggcctggttggaggaggccgaggccgcctaccgagagaagaacagcaagccagagctcttcaacggcagcgaacggaagcgcaaacgcacgtccatcgcggcgccggagaagcgttcactcgaggcctatttcgctatccagccacgtccttcatctgagaagatcgcggccatcgctgagaaactggaccttaaaaagaacgtggtgagagtctggttctgcaaccagagacagaaacagaaacgaatgaagtattcggctgtccactgattgcggcagggcgcagcgtcgggagccgggagagcctagtgctcatccctcccgggttcgggggatggttatcgggaactccaaggcgtttcctaggcaggttaggctctctcctccgaagccacagactttccccctttgtcccgcctggttgcctccggccttctctctctttcctttctattcccaccaaaaaaattttggcgctgggaaaatattgcagaagggcgggcctgagtgtacttgtgctgtccgtggtgctgaaatttgccctcgcgcaggggccgcacgacttcagagcaggagccccaaagcagaggacagtcaattggcccaaccgcccgaagctagggtgaa

SEQ ID NO: 125048 - DNA, 30 bp, Homo sapiens; identical to SEQ ID NO: 29983
  misc_feature 1..30: note = chr5:145720837-145720867
  misc_feature 1..30: note = Hyper
  source 1..30: mol_type = genomic DNA

SEQ ID NO: 125049 - DNA, 911 bp, Homo sapiens
  misc_feature 1..911: note = chr5:145722116-145723027
  misc_feature 1..911: note = Hyper
  source 1..911: mol_type = genomic DNA
cacatttccctgcttcgtcctcaaagagttgcgggtcatcaaaccacggggccgaaattcggagcagagtgggtttgccctccgcgcagtgcgacaccccctaccgcataagctaacttgcggatctcccccagctccctgggcctcagccctttacccccgccttgcacaacagccccagcgattcctccacctccctctccatcgggtgtcctttaataataaatgcccttatgccattacattatattgtgggttttgaaaatttaaaatacggctgatgcaatattaattgcctatagtggtataaaacacagggcaggagcccagccgggctgcagaggagacaaccgtgagcgtcccgcgccgaagcgaagcgctccagaaggacgcgcttttgcgggctgcaaggtttcctgcaggtaagaagagccttcgcatgttcgggctctggagagaaccggaaatctgcctccatcctcttttcgaaaagttctctgccgttatttatttagtctttttttttcttttaattgacaactgcaaaagtttgggagacttttacggagaggatgagaggagctgcctcctgagcgcaaggtctgctccaagacggtccagtagcactaggtccagtctccgagccatgcctctgagcctagtcttcttcaggcgcctgagacggtgatgcgcaggagtattttcaccagttcctacgtgcaggccggagctgcagcccggtcagcgaagcgctccaccctttccctcctcctgagtgcgccggaacggcgccgtcgcctcactcttcggcttgcttcaggaagcaactggagatgtggtttccccaggattgtgtagtcgcctttgccactcgtctggcggaggcacagacctctcgggggaggggaggt

SEQ ID NO: 125050 - DNA, 169 bp, Homo sapiens; identical to SEQ ID NO: 29986
  misc_feature 1..169: note = chr5:145723301-145723470
  misc_feature 1..169: note = Hyper
  source 1..169: mol_type = genomic DNA

SEQ ID NO: 125051 - DNA, 518 bp, Homo sapiens; identical to SEQ ID NO: 93086
  misc_feature 1..518: note = chr5:145724320-145724838
  misc_feature 1..518: note = Hyper
  source 1..518: mol_type = genomic DNA

SEQ ID NO: 125052 - DNA, 797 bp, Homo sapiens
  misc_feature 1..797: note = chr5:145725173-145725970
  misc_feature 1..797: note = Hyper
  source 1..797: mol_type = genomic DNA
tgcctttgcttcttccgttctcaagtgagatcacctctggctggggtggggaagcggaccgcctgggagtgaaggaggagcaggtgagtccgatttggcaccagattaggcagcgcgagcagaggaggtggtgggagccgagaacgcccgctgtcctcgccgggcttcggagcctccacgcctttgtgtcccgcgcgccactcgcgtctcccgtcctgtctgtgtgcgtctgttcgcgtgtctctcactcagcccctcttagcttccctccagcctcgcgggcgcgaaactctggcccccatgtgccggagcgagggggcccgcgtccccgggcgcgcgcagagtcgccttcccctctttcctctcttccgcagagcggcgggagcccccgcggtaaccccgccccggcgggcagacggagccagcgaggaccccggcggacaaattagtctccccttcgatcgctcttttccgatcaagtcaggtttcccctgttcccccgacggcgcttccgcactagcgcgactcccagggctccccggctgggtcagggttcgcccgctcctcccggcgcctccggataggggcttcccttcggctgcgtcccggcctgaggagtcccctggaccgcgggaggggcgattgccgggtccgcgcggctcagaatcctccccacgcgttgcttatacctttctttgtaaactgtcagatttctgccccctccctcagttcagccctgcgcagccttgcctgccactggaggcaaactgggacagaaactgcgctcgctctctttt

SEQ ID NO: 125053 - DNA, 1555 bp, Homo sapiens
  misc_feature 1..1555: note = chr5:146256927-146258482
  misc_feature 1..1555: note = Hyper
  source 1..1555: mol_type = genomic DNA
ttttaaaggccccaccgatcgcgttgctcaccccacgtgtcagcctcattcgctgcccgccagagcactatttccccagccacctttttatttttgctaatgcacttccaaaaggaaagaggttcgcccgtctgcaaagggctttttggggttttgattgtctaagcaggtaacctggccggccggggagatgaatgggcaggaaatgaaaccttgccctccctgcagccactgagagacataacatcgtttcgctcagggaggggggaccaaggtcctactgggcccctcccttcttatctccccccaagacccctgcgaacatctcggggaaggggtcatctgccttcctggggtcatctttctgggcgagagccccaccctgaaaaagcctaatccctgagggccattttaactcccgtgggcgccgggtccacctgctgctgaacgccgagctcgcctcgcggagcccggatggatgcgaggtgcactggggctgccggggccagccgagcccccgccccagccctagggcccggaggagtctccgccactacgcgcccagctgcccaggaagcacagtgatccgcaacttgcgcccggccccaacggcggaatgcggcggggctggcgttaccttcggtcgcatagctgtggtcgcgcaggaaactgttgttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagagaaaaaaaataaaaacccggcaatggagctgtcacctcctccactcgggttctgcgaggctgcggcggctcctcccgcgcggtgcgctcactccagctccagttcccagcgaggatgctgcgcctgcctccgctgcctccgggtgccaagatacgccgtgccccgaggggtctggtcccgcccgcccgccccggaggcgctcacaagcgggtctggggagatgcccaacaggttcccctccttggcagccgctccaaaatgcaaaaaagatccctcctccccctgggagagcgggcagccgcgacaaaatggtgcctttctggacccgagctgcagtggcgagatggcagggacaggattcaggcttgcctggccggaatgagggtgctggtcccacgggagggcggctccggcaggcgggggtagggaagctggcggggagctgggcagggcgctgcagccggcgccagcgcactcaccctcacacccacacgcgcgcactcgcagctgctgctgctgctgctgctgctgctgctgcaggaggctggaggcggctggtgcattaaaggcgaggctcctcccaaccgcgtcagcagccccacgactctttcccagcagcagtggtggccgaggcagaggctgcggctgctctttgctgcagtggggcgcatgcagccgcgaatcggcacctgggcagc

SEQ ID NO: 125054 - DNA, 375 bp, Homo sapiens; identical to SEQ ID NO: 93091
  misc_feature 1..375: note = chr5:146614106-146614481
  misc_feature 1..375: note = Hyper
  source 1..375: mol_type = genomic DNA

SEQ ID NO: 125055 - DNA, 65 bp, Homo sapiens; identical to SEQ ID NO: 93092
  misc_feature 1..65: note = chr5:146614703-146614768
  misc_feature 1..65: note = Hyper
  source 1..65: mol_type = genomic DNA

SEQ ID NO: 125056 - DNA, 36 bp, Homo sapiens; identical to SEQ ID NO: 29996
  misc_feature 1..36: note = chr5:146832654-146832690
  misc_feature 1..36: note = Hyper
  source 1..36: mol_type = genomic DNA

SEQ ID NO: 125057 - DNA, 158 bp, Homo sapiens; identical to SEQ ID NO: 93094
  misc_feature 1..158: note = chr5:146833012-146833170
  misc_feature 1..158: note = Hyper
  source 1..158: mol_type = genomic DNA

SEQ ID NO: 125058 - DNA, 106 bp, Homo sapiens; identical to SEQ ID NO: 93095
  misc_feature 1..106: note = chr5:146833649-146833755
  misc_feature 1..106: note = Hyper
  source 1..106: mol_type = genomic DNA

SEQ ID NO: 125059 - DNA, 1031 bp, Homo sapiens
  misc_feature 1..1031: note = chr5:146888811-146889842
  misc_feature 1..1031: note = Hyper
  source 1..1031: mol_type = genomic DNA
cccgggcatcccttccgcgcttgcacgaagatgctgcaagtggcgacacgcgcgaatccagggtctgggctaggaagtcgcgctacgctcagtggaggatgaccctttcctcctccttgtcccccagccccgtgcaaagtgagctggagaaagttgtgcccgggccatggcggccagggctggagaaaggaacgaaggcaaggagggaagtgacccggggcccccttaccttgtccttggggccgaggttctgcaacacctctttgccggtggcgctccggatctctaccccggcgggggcgggggaggcgggcgcgggctccctgctctcttcccggccttggcccctgcgcggggtgtccccctcgatcccgggccgactccccgatcctcggtcgctgccctggccgctccgaggagtcttcgcgccccgctgccccacgctgagggcatcgaaatccagcgtcttgctctcgaaggcgccctccacgttgcagaacatgccgccgtatttctgccgcgggacctggtccgtggtgcccggcctggccaggtacacgggcagatcgtcttcgtgggagctgtcccagcccctccggcccgaggccatggttcaagcacgaaagcggcccgcgggtttttcttccccagaggcggaaagggcagccgccggcagcgtgcgccgagccacagtgactgtggcgggaggaggcgcctgagccttcgcgccagaggcggcagtgctgctccgattcctgcttgtccctagcgagccagcgagccacacagccagctagcgcgcggagcaggggcccagagtagcgccgcgcttggctcactcgctggacctctcgcccggccgcacctcctcacgcacccccaaccctaacgtggcctcccgggctgacgcagcgtcggtgcccatcacaatcacaaaccaaacttggcgcgcgcgcacacgcacacacaggcgcacactgcccgctcgcgcaacagccttgcctcacacactttcgcgcaatttagacgtc

SEQ ID NO: 125060 - DNA, 332 bp, Homo sapiens
  misc_feature 1..332: note = chr5:148033722-148034054
  misc_feature 1..332: note = Hyper
  source 1..332: mol_type = genomic DNA
cccagccgctgcctgcgccctccctgccgccccctcgggtgcgggctccagcccccgcgctggggagccggcgagcgtgaggcgcgggccaggggctgcgggcgcaggaccccagccccggatcacctgggctcgccgcgcatcgtccttctccccaaccgagccggactccacgggctcaacagcccccagccccggtggtccccgctgccctgcccgctgccgcccccactgggcgccagggacagcgggggtgccgctctgccggcagggcgcacaggggagtgggcacagaggcgggctggagcgatctcacccgttccgggctggcc

SEQ ID NO: 125061 - DNA, 49 bp, Homo sapiens; identical to SEQ ID NO: 93109
  misc_feature 1..49: note = chr5:148205651-148205700
  misc_feature 1..49: note = Hyper
  source 1..49: mol_type = genomic DNA

SEQ ID NO: 125062 - DNA, 247 bp, Homo sapiens; identical to SEQ ID NO: 93110
  misc_feature 1..247: note = chr5:148206185-148206432
  misc_feature 1..247: note = Hyper
  source 1..247: mol_type = genomic DNA

SEQ ID NO: 125063 - DNA, 272 bp, Homo sapiens; identical to SEQ ID NO: 30002
  misc_feature 1..272: note = chr5:148521059-148521331
  misc_feature 1..272: note = Hyper
  source 1..272: mol_type = genomic DNA

SEQ ID NO: 125064 - DNA, 964 bp, Homo sapiens; identical to SEQ ID NO: 93112
  misc_feature 1..964: note = chr5:148651223-148652187
  misc_feature 1..964: note = Hyper
  source 1..964: mol_type = genomic DNA

SEQ ID NO: 125065 - DNA, 18 bp, Homo sapiens
  misc_feature 1..18: note = chr5:148872640-148872658
  misc_feature 1..18: note = Hypo
  source 1..18: mol_type = genomic DNA
ttgttgttgttgagacgg

SEQ ID NO: 125066 - DNA, 25 bp, Homo sapiens
  misc_feature 1..25: note = chr5:148928401-148928426
  misc_feature 1..25: note = Hypo
  source 1..25: mol_type = genomic DNA
gcgaaaactccgtcttaaagaagag

SEQ ID NO: 125067 - DNA, 63 bp, Homo sapiens; identical to SEQ ID NO: 93117
  misc_feature 1..63: note = chr5:149005075-149005138
  misc_feature 1..63: note = Hypo
  source 1..63: mol_type = genomic DNA

SEQ ID NO: 125068 - DNA, 149 bp, Homo sapiens; identical to SEQ ID NO: 40606
  misc_feature 1..149: note = chr5:149014648-149014797
  misc_feature 1..149: note = Hypo
  source 1..149: mol_type = genomic DNA

SEQ ID NO: 125069 - DNA, 240 bp, Homo sapiens; identical to SEQ ID NO: 93119
  misc_feature 1..240: note = chr5:149311635-149311875
  misc_feature 1..240: note = Hypo
  source 1..240: mol_type = genomic DNA

SEQ ID NO: 125070 - DNA, 90 bp, Homo sapiens
  misc_feature 1..90: note = chr5:149546573-149546663
  misc_feature 1..90: note = Hyper
  source 1..90: mol_type = genomic DNA
ctccagctactctcacgtggagccggcccccgcgcccccgacggcctggggggcgcccttccctgcgcccaaggacgactgggccgccgc

SEQ ID NO: 125071 - DNA, 154 bp, Homo sapiens; identical to SEQ ID NO: 93122
  misc_feature 1..154: note = chr5:149547723-149547877
  misc_feature 1..154: note = Hypo
  source 1..154: mol_type = genomic DNA

SEQ ID NO: 125072 - DNA, 401 bp, Homo sapiens; identical to SEQ ID NO: 93123
  misc_feature 1..401: note = chr5:149569485-149569886
  misc_feature 1..401: note = Hyper
  source 1..401: mol_type = genomic DNA

SEQ ID NO: 125073 - DNA, 30 bp, Homo sapiens; identical to SEQ ID NO: 40607
  misc_feature 1..30: note = chr5:149624264-149624294
  misc_feature 1..30: note = Hypo
  source 1..30: mol_type = genomic DNA

SEQ ID NO: 125074 - DNA, 34 bp, Homo sapiens; identical to SEQ ID NO: 93126
  misc_feature 1..34: note = chr5:149681755-149681789
  misc_feature 1..34: note = Hyper
  source 1..34: mol_type = genomic DNA

SEQ ID NO: 125075 - DNA, 682 bp, Homo sapiens; identical to SEQ ID NO: 93127
  misc_feature 1..682: note = chr5:149682009-149682691
  misc_feature 1..682: note = Hyper
  source 1..682: mol_type = genomic DNA

SEQ ID NO: 125076 - DNA, 211 bp, Homo sapiens; identical to SEQ ID NO: 93128
  misc_feature 1..211: note = chr5:149810703-149810914
  misc_feature 1..211: note = Hypo
  source 1..211: mol_type = genomic DNA

SEQ ID NO: 125077 - DNA, 734 bp, Homo sapiens; identical to SEQ ID NO: 30008
  misc_feature 1..734: note = chr5:150051058-150051792
  misc_feature 1..734: note = Hyper
  source 1..734: mol_type = genomic DNA

SEQ ID NO: 125078 - DNA, 76 bp, Homo sapiens; identical to SEQ ID NO: 93130
  misc_feature 1..76: note = chr5:150052035-150052111
  misc_feature 1..76: note = Hyper
  source 1..76: mol_type = genomic DNA

SEQ ID NO: 125079 - DNA, 232 bp, Homo sapiens
  misc_feature 1..232: note = chr5:150158219-150158451
  misc_feature 1..232: note = Hyper
  source 1..232: mol_type = genomic DNA
tccccgaacgcagcccgcaggggacgctggaggaggagctgagctggagttgccggggccccgggaccgggcgttccgggggcggtccccagcagccgcgcattccagagccagcagcgcgtcctggccgctcctgcgctctcccgcctcccggggctcggaggagccggggcacgttccaggagctgcctagggctgaggttccaggcctgggggtcgcttccagctgcca

SEQ ID NO: 125080 - DNA, 696 bp, Homo sapiens; identical to SEQ ID NO: 93132
  misc_feature 1..696: note = chr5:150399922-150400618
  misc_feature 1..696: note = Hyper
  source 1..696: mol_type = genomic DNA

SEQ ID NO: 125081 - DNA, 104 bp, Homo sapiens; identical to SEQ ID NO: 93133
  misc_feature 1..104: note = chr5:150537549-150537653
  misc_feature 1..104: note = Hyper
  source 1..104: mol_type = genomic DNA

SEQ ID NO: 125082 - DNA, 30 bp, Homo sapiens; identical to SEQ ID NO: 93134
  misc_feature 1..30: note = chr5:150577129-150577159
  misc_feature 1..30: note = Hypo
  source 1..30: mol_type = genomic DNA

SEQ ID NO: 125083 - DNA, 30 bp, Homo sapiens; identical to SEQ ID NO: 93135
  misc_feature 1..30: note = chr5:150829685-150829715
  misc_feature 1..30: note = Hypo
  source 1..30: mol_type = genomic DNA

SEQ ID NO: 125084 - DNA, 60 bp, Homo sapiens; identical to SEQ ID NO: 93136
  misc_feature 1..60: note = chr5:150901687-150901747
  misc_feature 1..60: note = Hypo
  source 1..60: mol_type = genomic DNA

SEQ ID NO: 125085 - DNA, 177 bp, Homo sapiens; identical to SEQ ID NO: 93137
  misc_feature 1..177: note = chr5:150911205-150911382
  misc_feature 1..177: note = Hypo
  source 1..177: mol_type = genomic DNA

SEQ ID NO: 125086 - DNA, 248 bp, Homo sapiens; identical to SEQ ID NO: 93138
  misc_feature 1..248: note = chr5:151066252-151066500
  misc_feature 1..248: note = Hyper
  source 1..248: mol_type = genomic DNA

SEQ ID NO: 125087 - DNA, 118 bp, Homo sapiens; identical to SEQ ID NO: 93139
  misc_feature 1..118: note = chr5:151150563-151150681
  misc_feature 1..118: note = Hyper
  source 1..118: mol_type = genomic DNA

SEQ ID NO: 125088 - DNA, 28 bp, Homo sapiens
  misc_feature 1..28: note = chr5:151251400-151251428
  misc_feature 1..28: note = Hypo
  source 1..28: mol_type = genomic DNA
aggcgtgaaccaccgcgcccggccgtga

SEQ ID NO: 125089 - DNA, 542 bp, Homo sapiens
  misc_feature 1..542: note = chr5:151304211-151304753
  misc_feature 1..542: note = Hyper
  source 1..542: mol_type = genomic DNA
gatgttaaagggaggcggggaacaggggcgcggagggagagccccaggggaaattggagcgagggggtcgtagataccacggacagcggcggctgcgaggcgtttcagcaccacggagagcgtccagacctgcttttcaggagcgcgaagagtattgctgtttgttaaactccagcgtgtctgttggctccctgcggcgctggggaggcacgtttgggggtgggtatatttccttttttttttttttttttttaaacccctgtttttctgtttaaacggccagctccctgcaaggaaaaaaatcttctgtggagatcagagcgctggcctcggaccgttggattgggcgagcatcttgggtaaagagaacagagctttatggctctgggccggcctgagggggttaggggcgaggggaaagcggttgacggcgctgccttcagttaaatctcggagagtgtgccaggctggcgcatcgcaatccagtctcggaatctcgttctcctgcctctgtgcgggtctgctgtcgccttgctattcct

SEQ ID NO: 125090 - DNA, 42 bp, Homo sapiens; identical to SEQ ID NO: 93143
  misc_feature 1..42: note = chr5:151383718-151383760
  misc_feature 1..42: note = Hypo
  source 1..42: mol_type = genomic DNA

SEQ ID NO: 125091 - DNA, 130 bp, Homo sapiens; identical to SEQ ID NO: 93144
  misc_feature 1..130: note = chr5:151784174-151784304
  misc_feature 1..130: note = Hypo
  source 1..130: mol_type = genomic DNA

SEQ ID NO: 125092 - DNA, 30 bp, Homo sapiens; identical to SEQ ID NO: 93145
  misc_feature 1..30: note = chr5:152760944-152760974
  misc_feature 1..30: note = Hypo
  source 1..30: mol_type = genomic DNA

SEQ ID NO: 125093 - DNA, 214 bp, Homo sapiens; identical to SEQ ID NO: 93146
  misc_feature 1..214: note = chr5:152870105-152870319
  misc_feature 1..214: note = Hyper
  source 1..214: mol_type = genomic DNA

SEQ ID NO: 125094 - DNA, 33 bp, Homo sapiens; identical to SEQ ID NO: 93148
  misc_feature 1..33: note = chr5:152979673-152979706
  misc_feature 1..33: note = Hypo
  source 1..33: mol_type = genomic DNA

SEQ ID NO: 125095 - DNA, 21 bp, Homo sapiens
  misc_feature 1..21: note = chr5:153118296-153118317
  misc_feature 1..21: note = Hypo
  source 1..21: mol_type = genomic DNA
ttggagaaggcatttcgctct

SEQ ID NO: 125096 - DNA, 188 bp, Homo sapiens; identical to SEQ ID NO: 93150
  misc_feature 1..188: note = chr5:153131278-153131466
  misc_feature 1..188: note = Hypo
  source 1..188: mol_type = genomic DNA

SEQ ID NO: 125097 - DNA, 160 bp, Homo sapiens; identical to SEQ ID NO: 93151
  misc_feature 1..160: note = chr5:153558736-153558896
  misc_feature 1..160: note = Hypo
  source 1..160: mol_type = genomic DNA

SEQ ID NO: 125098 - DNA, 47 bp, Homo sapiens; identical to SEQ ID NO: 93152
  misc_feature 1..47: note = chr5:153569225-153569272
  misc_feature 1..47: note = Hyper
  source 1..47: mol_type = genomic DNA

SEQ ID NO: 125099 - DNA, 93 bp, Homo sapiens; identical to SEQ ID NO: 93153
  misc_feature 1..93: note = chr5:153785959-153786052
  misc_feature 1..93: note = Hypo
  source 1..93: mol_type = genomic DNA

SEQ ID NO: 125100 - DNA, 1111 bp, Homo sapiens
  misc_feature 1..1111: note = chr5:153852408-153853519
  misc_feature 1..1111: note = Hyper
  source 1..1111: mol_type = genomic DNA
gccgttctctgtgctcggcttttccagctgtgcggtgggagctggggatgtggcgtgggcgtgggaggccgctggagtcaggcgtggggagagtgggggactatccagtgaccctctcaatgggcgccggctccgtctcggctcccgggttcagggactgcacgtttctgagaccgagtttagggctccaaggctctcttcccaaagagggtttggggccagcaggattgggttttctgaagaggcctggttatgccagacttggctttggcggccgctggcgggtctccctcagcaccccctcttctttccccggctataagaaagctagaccagggtgcgcattcttcccgtgcctaggatacttcacggtgctaaaaatagtcctgggagctgggacctgtgtatagccagaggtttgtgtgtgagcgaagttggagtcctgggttcgaatctagataagcttccctccgtgctgtggggcttagatcacctccctccctgagtctgtttctccatgcgcgccggaatttctaaacggactcccagaaagaaacggaaagaaagaaggtaaagaaaagaaaaacaaaacaacaagaaagaaactttgatttttctctctgctcctccccaagggccctggggcctcgggccgggtactgaggccgaggaaggggtgcgtcggacaggctcattaccgccaagtgttgccctagttaaatcgcgggcctgtttgatctggcggcgggtggcgagagggaaaaaagaaaaaagtaggggggcgagagtagagagagaagctcacacctcccccactgtttcctagcgcccataaaacaccttttattaactccttcgcgtccggaaaggcccgcgtggcctctcggcccctgctacggtgtttacagccaagactaatggggtcccatattcaccccgacgctgggacaaggcgcctggggcacgcctggtgccccacgaggccctgccccggagctgcctgaggtctcctttcttgttcccaagccgagcgctcaggctccaggtgcgcagagcgaaagttccaagacagcctcacgggtctcccctcctccttcgcagtgagcgccgc

SEQ ID NO: 125101 - DNA, 30 bp, Homo sapiens; identical to SEQ ID NO: 93156
  misc_feature 1..30: note = chr5:153854871-153854901
  misc_feature 1..30: note = Hyper
  source 1..30: mol_type = genomic DNA

SEQ ID NO: 125102 - DNA, 2706 bp, Homo sapiens
  misc_feature 1..2706: note = chr5:153855175-153857881
  misc_feature 1..2706: note = Hyper
  source 1..2706: mol_type = genomic DNA
tcaaaggacattgcacgtgcgatccaagtgtgtggttgcagccgacgacctgccggcgctcagcagaagctccgcgggatgcgtagcaccagtcgccggagcccagagcctggcgttcgccgctgccttcctctcctcccggggcttcaggagtggctggcctggccaggtcctcggcgcgggcctcggctcactggtttaactccagcgcccagacttgctgcggccagccggtgcgtcctttaatcctcttctcgactgggcccagggcaggaggaaaaccttcgtgctgctgctgccaaaggacacacagaagaaaagaggcgggagagacaggttttaatttttctgctccgatcgcccggcatggggtaagatgaggaggaggggaaggtgtcgggagcagtaactgggagtctttaaataagtgacggatttctgtttgcgaaataggcaaacaggctcgtaaatttgcctttatgcgcggagttcctgggacccgggatgggctgggcagcttcgggaggtttggtaaggaaaatgttctgcgtctggtgaaactgacgcgcgttgatttggctttaggacacctaagggagatcccaggatattggaagggaggggtggaaatccacggttctcccgctctcgctgcaccccacacacttccgccagcctcccaacctggtttaaacatcagggcttggatgcaggcttggggccccctaagccggagctgggagcctcagatacggaggtaaaagagcggggagtcgagctggcctagcgtcctccttcccgctctttcagcaggaaccaagcggtgctacttgaaggaggcggcgacgcgtgggggccgggatccgcccaataacaacttctttcgaggcgccgcacctcgaaagaagccggcctgcaccatccccagtccggggcagccgtttagagactcgatgcctatttatctttccctcgtccctggatgagctttcgtcagtttaccacaggcccccgcaggttggataaaccaggtggggcgcttcagctggctccactccgctacggccttaagccccccaacctagagaaactgattggccagcctgaaaacccagcgctcagaagcccccagccccggacagccagaccgagtgccaggaagtgtcaccctaaccggagaggatcaagaaggccaagacgagactgcgctctccaaagctaaaagaagtggctcttatttacatgcaaagccactgaagtcgtcctcagaaccagtccatggggagaaccagaactggccctggactgagtagaagacccgatctgttttacctcacctccaccctggactcctcagataggtgcttttcctgccccgacccactctgggccctcagtttccctatttatacaatgatggaagtagactagccggtccagcaaaggccctttgaaaacaggaaccgagcccgggcacataaattcaaactcaaagtaaagaactttaacacatattcttaacctggcttccaggagagcccaggaatgaatcaggacttctccaaattggaagcaaaacctgtggtgtgtgcatttttggagggtccgaggctccaaacagattattcactcagtattacaaacactctcccgtattacaaatgaattctatgacgaatctgcctccctccatgcacaggatcgcacgctgtgaccaaccatctcagaactcttcccaacctttccaaatcggacacaggacaacacagcctccttcgactacctgcatggcctgaggctgctcaccgctcctgcacccttggctggagcatgcaagccccaggactcaccagctcccttttccgcttgctctcacggccgccatccgccttcttgagttcagccttgaaggcctcgggatcgccagactgtgcatccttggccagcacgtccatcaggtaggcgatgtagctggtggctaggcgcagagtcttgatcttggagagcttggtgtcggccggcacgttggggatgcactcgcgcaactccgcgaatgcgctgttaatgctctcagtgcgtctccgctccttcttgggtcctgagcctttccgccggccaagacggccgccaagcgcctccagccgcccggggctctgcccaggcctggcgtcaggaccataggcggtggcggctgcagcggccgcgggcggcggcccgcccgcagggaagtccggggcagcgtcagccgggctcagcagccagctctggaagtagggcctttcctgatgacagcgcgaggccggaccgaagaggaagggttcgtggagcatggggtgcgcagggtgcgggtggtgatggtggtgatggtgtgcgtagctgcccacgaggttcatgttggagcggctactggcctgcgccgccagccctattaacgccgctccatgcgccccagagactgccgggggccacctgtgggctctggagccactactgggcgccggctttgggagagtccgggcaaggctgaaaatgagacgcgcagcccactgtcttcttaccggtttctgccgcgggcgaggtcgccgaagcccaaagacctgtttaacccttctgcggactcccctgcggatctggcttatataagaccgcggctttgatgtcaacctctcccgggagccaatggcaggggggcggggataaggaaaa

SEQ ID NO: 125103 - DNA, 1689 bp, Homo sapiens
  misc_feature 1..1689: note = chr5:153858119-153859808
  misc_feature 1..1689: note = Hyper
  source 1..1689: mol_type = genomic DNA
tccagaatcaccaagcgaaaagaaggcctacacctagagcccgccttttgattttacagacaaggaaactgaggcccagggaaagaaaggttcttgtttctagactgtctagaagtctaaataggaattccagcagttcccagtcccgagctccaactgctctgctcggcgtcagagctagaagatgagagggcgctgctgaagacaggataggccgctaacgttcttccctaacaccttccagccctccgcccccacccccaccccttagtcatcggccctttctggagagactgggagccgcttgtgcacggggtcgttaccagcccgccaattctgacccagcctcaggcagacgggcacgcagctactgaccagcgaagaagcctttcggaggcaggggtaggggtggggcgggaaggaggaggcggactccaggcccacgggcatcgacgggtttgttcccggcttgagggtctgagatccactccggcctcccgggtgcctgatccattccgaaggccagcccggctggcgcagagacagtctggcgtccgccttgggcccggggcatctggccagcaggtctcctctggtctgtccgcaggactcgcaccgagacctgggagcgcggctacgtcgggccgctctacccagatcatcactccttaagaatctttggttctttaaagacaccggccccgaagctcacacctcgagacaccagcattcggcgttagacacacgcagaggggaccaagactgcacagcatccgcgaggctcgcacaggcaaacgcgacgtccggcatctctcacgcatcagcgcagaggcgcgactcggctgcacgaccctccgagatttcaccccgggggtagggccattccctgccagccggactctctccactgtgggctttccccaggctcgcgttggaatctgggaatcccggagtggtgacgcttcaagctggggactctcggtcttacctcccgctgtggttcctttcttggccgatgtccacctacctgggtccctcattctctcaacctttctcagctcaacgccccctccctcggtgtggtagagggagtgtgcctctcttcaaagcaaagtcgaggggagggggaaaggagaagttaatgtgagtgctctttttagaaggcaaatcattcacccattcattcaacaattatttattgatgcctactatgtgcctatcatagttactagtccaaagacagagggagaaaggcccattctctccttgaacagatatggaacgtgaagcccagagaagaagagcgattttctcgaggtccggtagggagtggatgagtggaattccactcctggacaagagagtgaatgaagggtggggggttacatacaggagtgacggagacaaaagcctgggcctgctggttccacctgtgggagctcagcagggctgtgggccctggaggtgcatgggggggtggtgcagggaggtcctggtttcctgcccgaggcgggctggaaaccccccgctctccccggcgcctggcgccagcagcgctggggtagggcagagcgcggagccggaggcacgcggggagggagcgctgggggcccgctgctgcggcggctctgcggggtcccaagcctccctggcctggaggcattctagaaagagcgcaggtagagagta

SEQ ID NO: 125104 - DNA, 540 bp, Homo sapiens
  misc_feature 1..540: note = chr5:153862037-153862577
  misc_feature 1..540: note = Hyper
  source 1..540: mol_type = genomic DNA
taggacagctgtacccgggcaatgcgaaggtccctcaagcctggacgttctgcagtggtggggtctcgctcttgccctagcccctctcctaccctcacccctatccgcgccccccggactggcaggcctctggaagcccaggccgcggcgcctaccgcaaaaccttctcccgccgcagtcccgtgaccttgacgccacgggcaatccccgcaccggaccccttatctaaatagggcagtaaatcaaggacctgtcagggcccgggtaattacaggaactccataaaaaggacccggccggccgcctgtttatattagcgcggtgtaaaatattctcgctgtcttggggaatcgcgtcgcgcagtaacgcgccataaatcagcccgcggaccatttaccccgcagcttgagcgcgcaaatcccttaaacatttctctgccatgtctgaagaggacctaggactttccaatctggcccagcctgctcccagggatgggggacagtcggggcagggaagagataggcacggagtagattgctc

SEQ ID NO: 125105 - DNA, 277 bp, Homo sapiens
  misc_feature 1..277: note = chr5:153863373-153863650
  misc_feature 1..277: note = Hyper
  source 1..277: mol_type = genomic DNA
cctctgtgtattttccgcacagagagatgtctgcttcgggacgcgttcaacctaaacagaacccggtctgattggaaaatgtatttatttgaaaaatcgtaactcacggttttggtgaaaacggcccccaaatttatgggatcgcttggggcgcagcgattgtaaatcaaaaggcactggacacctccctcccccatccccgaagcagctcggtcaggttctccagaacaccaggagtcctgtctcctcccggtccaccctgcggccctccgagacc

SEQ ID NO: 125106 - DNA, 30 bp, Homo sapiens; identical to SEQ ID NO: 30029
  misc_feature 1..30: note = chr5:153863972-153864002
  misc_feature 1..30: note = Hyper
  source 1..30: mol_type = genomic DNA

SEQ ID NO: 125107 - DNA, 30 bp, Homo sapiens; identical to SEQ ID NO: 93168
  misc_feature 1..30: note = chr5:153900800-153900830
  misc_feature 1..30: note = Hyper
  source 1..30: mol_type = genomic DNA

SEQ ID NO: 125108 - DNA, 530 bp, Homo sapiens; identical to SEQ ID NO: 93169
  misc_feature 1..530: note = chr5:153990744-153991274
  misc_feature 1..530: note = Hyper
  source 1..530: mol_type = genomic DNA

SEQ ID NO: 125109 - DNA, 78 bp, Homo sapiens; identical to SEQ ID NO: 93170
  misc_feature 1..78: note = chr5:154071660-154071738
  misc_feature 1..78: note = Hypo
  source 1..78: mol_type = genomic DNA

SEQ ID NO: 125110 - DNA, 254 bp, Homo sapiens; identical to SEQ ID NO: 40613
  misc_feature 1..254: note = chr5:154209733-154209987
  misc_feature 1..254: note = Hypo
  source 1..254: mol_type = genomic DNA

SEQ ID NO: 125111 - DNA, 101 bp, Homo sapiens; identical to SEQ ID NO: 93172
  misc_feature 1..101: note = chr5:154318077-154318178
  misc_feature 1..101: note = Hypo
  source 1..101: mol_type = genomic DNA

SEQ ID NO: 125112 - DNA, 16 bp, Homo sapiens
  misc_feature 1..16: note = chr5:154376080-154376096
  misc_feature 1..16: note = Hypo
  source 1..16: mol_type = genomic DNA
agaattaagactgggc

SEQ ID NO: 125113 - DNA, 30 bp, Homo sapiens; identical to SEQ ID NO: 93174
  misc_feature 1..30: note = chr5:154393651-154393681
  misc_feature 1..30: note = Hypo
  source 1..30: mol_type = genomic DNA

SEQ ID NO: 125114 - DNA, 33 bp, Homo sapiens; identical to SEQ ID NO: 93175
  misc_feature 1..33: note = chr5:154398961-154398994
  misc_feature 1..33: note = Hypo
  source 1..33: mol_type = genomic DNA

SEQ ID NO: 125115 - DNA, 520 bp, Homo sapiens; identical to SEQ ID NO: 93182
  misc_feature 1..520: note = chr5:155107388-155107908
  misc_feature 1..520: note = Hyper
  source 1..520: mol_type = genomic DNA

SEQ ID NO: 125116 - DNA, 717 bp, Homo sapiens
  misc_feature 1..717: note = chr5:155108132-155108849
  misc_feature 1..717: note = Hyper
  source 1..717: mol_type = genomic DNA
agcgcgatgctgcttcgcttcttctaggcggcggccggcggaggctttccgcagccgcttggccggcgccggcccctattccgttggcaagtcccttgtctatcccggagggcgcacccggacgctcgagccggagcgagcgcgaagtccgaagtccgcccccagagccgccaacttccctgtgagcccctctccccgccgcagcctgcgccagacctgggagcgatgcgcccccacccgggcggcgcgccctctgccaactcgccacccatgggatcgactgccctcagctgcccggcttggagtgcgtagccttcgccgcgtggcccaggagaggagcgagacaccaaggcgtttcgcggactccgcgcgcaccagtcggcttggtggccctgcgggatagcgtttatacccaggggtgagtaggccgctaatggaggccccctttacccccagctagcggcttgcatggacggcaaagagacgggagaaagttgggtctccttgcgcttaatctggcattggcagaggaatgcaacactgtttcctccaactcgattgccgcgggggtttccccagttccctccatctctaagccaaggagggagtccccttccgcttcctaaggagaaaaggggctccctagagcagatcgctgacttcctcaccaacgtgccatttggggcttttcagccgcccgcgcgttaagctagctcc

SEQ ID NO: 125117 - DNA, 384 bp, Homo sapiens
  misc_feature 1..384: note = chr5:155109115-155109499
  misc_feature 1..384: note = Hyper
  source 1..384: mol_type = genomic DNA
atccgcggtgcggtgcgggttttaggggcgcacaatacagggtgtccagacagagtccaacaggtggcctgcgcgggcatcctgtggctaggcgcgggggaggggaacggctccctccccgagccccgggctgcctctgctgcttctaggggtgcatctgaacatggataaggaaatgcgctccctgctctcaggccctatttggggtgagtgtgtgaggcatccaaatgcctcctgtcggaaaacagcggcctcattgtgtgcccgattgaggtttcaacttgcaggcaactgagaggccattcagctgggcagcacggagttggctggtcctcggacttgagccatggccttccccacgatccctggcggcagtatcccagc

SEQ ID NO: 125118 - DNA, 21 bp, Homo sapiens
  misc_feature 1..21: note = chr5:156384996-156385017
  misc_feature 1..21: note = Hypo
  source 1..21: mol_type = genomic DNA
agatctggccgggcgcggtgg

SEQ ID NO: 125119 - DNA, 183 bp, Homo sapiens; identical to SEQ ID NO: 93188
  misc_feature 1..183: note = chr5:156472913-156473096
  misc_feature 1..183: note = Hypo
  source 1..183: mol_type = genomic DNA

SEQ ID NO: 125120 - DNA, 30 bp, Homo sapiens; identical to SEQ ID NO: 93189
  misc_feature 1..30: note = chr5:156522857-156522887
  misc_feature 1..30: note = Hypo
  source 1..30: mol_type = genomic DNA

SEQ ID NO: 125121 - DNA, 38 bp, Homo sapiens; identical to SEQ ID NO: 93190
  misc_feature 1..38: note = chr5:156591428-156591466
  misc_feature 1..38: note = Hypo
  source 1..38: mol_type = genomic DNA

SEQ ID NO: 125122 - DNA, 30 bp, Homo sapiens; identical to SEQ ID NO: 93191
  misc_feature 1..30: note = chr5:156672960-156672990
  misc_feature 1..30: note = Hypo
  source 1..30: mol_type = genomic DNA

SEQ ID NO: 125123 - DNA, 584 bp, Homo sapiens; identical to SEQ ID NO: 93192
  misc_feature 1..584: note = chr5:156874096-156874680
  misc_feature 1..584: note = Hypo
  source 1..584: mol_type = genomic DNA

SEQ ID NO: 125124 - DNA, 455 bp, Homo sapiens; identical to SEQ ID NO: 30035
  misc_feature 1..455: note = chr5:156887049-156887504
  misc_feature 1..455: note = Hyper
  source 1..455: mol_type = genomic DNA

SEQ ID NO: 125125 - DNA, 30 bp, Homo sapiens; identical to SEQ ID NO: 93194
  misc_feature 1..30: note = chr5:156960564-156960594
  misc_feature 1..30: note = Hypo
  source 1..30: mol_type = genomic DNA

SEQ ID NO: 125126 - DNA, 132 bp, Homo sapiens; identical to SEQ ID NO: 93195
  misc_feature 1..132: note = chr5:157001726-157001858
  misc_feature 1..132: note = Hyper
  source 1..132: mol_type = genomic DNA

SEQ ID NO: 125127 - DNA, 106 bp, Homo sapiens; identical to SEQ ID NO: 93196
  misc_feature 1..106: note = chr5:157002098-157002204
  misc_feature 1..106: note = Hyper
  source 1..106: mol_type = genomic DNA

SEQ ID NO: 125128 - DNA, 370 bp, Homo sapiens; identical to SEQ ID NO: 93197
  misc_feature 1..370: note = chr5:157002447-157002817
  misc_feature 1..370: note = Hyper
  source 1..370: mol_type = genomic DNA

SEQ ID NO: 125129 - DNA, 143 bp, Homo sapiens; identical to SEQ ID NO: 93198
  misc_feature 1..143: note = chr5:157041326-157041469
  misc_feature 1..143: note = Hypo
  source 1..143: mol_type = genomic DNA

SEQ ID NO: 125130 - DNA, 42 bp, Homo sapiens; identical to SEQ ID NO: 93199
  misc_feature 1..42: note = chr5:157078407-157078449
  misc_feature 1..42: note = Hypo
  source 1..42: mol_type = genomic DNA

SEQ ID NO: 125131 - DNA, 469 bp, Homo sapiens; identical to SEQ ID NO: 93200
  misc_feature 1..469: note = chr5:157098271-157098740
  misc_feature 1..469: note = Hyper
  source 1..469: mol_type = genomic DNA

SEQ ID NO: 125132 - DNA, 135 bp, Homo sapiens; identical to SEQ ID NO: 93201
  misc_feature 1..135: note = chr5:157852959-157853094
  misc_feature 1..135: note = Hypo
  source 1..135: mol_type = genomic DNA

SEQ ID NO: 125133 - DNA, 18 bp, Homo sapiens
  misc_feature 1..18: note = chr5:157881508-157881526
  misc_feature 1..18: note = Hypo
  source 1..18: mol_type = genomic DNA
tggagcagaaaggggcgg

SEQ ID NO: 125134 - DNA, 66 bp, Homo sapiens; identical to SEQ ID NO: 93203
  misc_feature 1..66: note = chr5:158139390-158139456
  misc_feature 1..66: note = Hypo
  source 1..66: mol_type = genomic DNA

SEQ ID NO: 125135 - DNA, 30 bp, Homo sapiens; identical to SEQ ID NO: 93204
  misc_feature 1..30: note = chr5:158250354-158250384
  misc_feature 1..30: note = Hypo
  source 1..30: mol_type = genomic DNA

SEQ ID NO: 125136 - DNA, 30 bp, Homo sapiens; identical to SEQ ID NO: 93205
  misc_feature 1..30: note = chr5:158398433-158398463
  misc_feature 1..30: note = Hypo
  source 1..30: mol_type = genomic DNA

SEQ ID NO: 125137 - DNA, 374 bp, Homo sapiens
  misc_feature 1..374: note = chr5:158478441-158478815
  misc_feature 1..374: note = Hyper
  source 1..374: mol_type = genomic DNA
cccacccccccaccccgccgcccggcggctgacggctcccgctccacatgtgcgactcgtgtttcggctttcgctggcgacaaactggagccggggcctttccgcttaggaggaactcgctacgtgtcgctaacaacaacacaaacaccgccggcccggctcggtgctccgctgcccacagtgcgctcggcaccagggctggatttatagcaaggagccccgactgtaagaagtaattcatgagtccccacaatgccactactgagaggcattcagaagggggggcaagacacggggtgttcctgctccgtggcctccatcccagccgatcccgctttgcagttgtgcacaatcacaatcgcagccagcagttt

SEQ ID NO: 125138 - DNA, 123 bp, Homo sapiens
  misc_feature 1..123: note = chr5:158524625-158524748
  misc_feature 1..123: note = Hyper
  source 1..123: mol_type = genomic DNA
agctctggccaactgcgagtgcccggccttgggaagccacatccccccaccaccaaaaagcatgtggagaagggtccgagggcggggctcagaactgtcgcgggtggtcgctgtgaaaaaggg

SEQ ID NO: 125139 - DNA, 289 bp, Homo sapiens; identical to SEQ ID NO: 30043
  misc_feature 1..289: note = chr5:158526129-158526418
  misc_feature 1..289: note = Hyper
  source 1..289: mol_type = genomic DNA

SEQ ID NO: 125140 - DNA, 754 bp, Homo sapiens
  misc_feature 1..754: note = chr5:158527373-158528127
  misc_feature 1..754: note = Hyper
  source 1..754: mol_type = genomic DNA
gcggggcccgcgcatcgaggccccgccccttcatttgcataacgtcatctttccgcccaccgcagccaatcgcggcccgggagccggctcgctggcggcgccaggccacgctctctcattaacatcccgctcccggtggcgcaggggagccggccaaagttcctcgcaaagtggcgagcgaaggagcgctgagcactgacgtctgggctggggaggagcgggtccgagcgaggacggagaggggacagagggaaagggaggcgggtgtcttcctcaggaatttgagctggggatctgcatcctggccattgcagtcctttagcatcctcgccgcgccctgagcgcgctggaggctcgcaggctgcgccctcccagggctgatgccgcgtcctgctccgccgttctgggacgtcggggacaaaagtggaggagacgggagagcccgggcagaaaaagcaggacgcgcgtcccaggtgcccacctcttcgctttgaggcgggggcggtgggatggaatatgggtgcgcgaggtcggggctggtaactctcggaggggcacggcctccacgctgggagggatgaatggacgctgggccccggcaaatgaggcgctgtgggtccccaggaagtggggtaccaggctctactcccaccccggcctctgaaacgcttctctctcggccgctagcctagaggctgccagggttgggcactgttctcactcacacgctcacctctctcgggcagtcctcgag

SEQ ID NO: 125141 - DNA, 246 bp, Homo sapiens; identical to SEQ ID NO: 93212
  misc_feature 1..246: note = chr5:158533542-158533788
  misc_feature 1..246: note = Hyper
  source 1..246: mol_type = genomic DNA

SEQ ID NO: 125142 - DNA, 141 bp, Homo sapiens; identical to SEQ ID NO: 93213
  misc_feature 1..141: note = chr5:158612852-158612993
  misc_feature 1..141: note = Hypo
  source 1..141: mol_type = genomic DNA

SEQ ID NO: 125143 - DNA, 189 bp, Homo sapiens; identical to SEQ ID NO: 93214
  misc_feature 1..189: note = chr5:158875177-158875366
  misc_feature 1..189: note = Hypo
  source 1..189: mol_type = genomic DNA

SEQ ID NO: 125144 - DNA, 324 bp, Homo sapiens; identical to SEQ ID NO: 93215
  misc_feature 1..324: note = chr5:159200128-159200452
  misc_feature 1..324: note = Hyper
  source 1..324: mol_type = genomic DNA

SEQ ID NO: 125145 - DNA, 261 bp, Homo sapiens; identical to SEQ ID NO: 93217
  misc_feature 1..261: note = chr5:159343387-159343648
  misc_feature 1..261: note = Hyper
  source 1..261: mol_type = genomic DNA

SEQ ID NO: 125146 - DNA, 644 bp, Homo sapiens
  misc_feature 1..644: note = chr5:159399066-159399710
  misc_feature 1..644: note = Hyper
  source 1..644: mol_type = genomic DNA
ccgccgtcgcctgggcggctgcgcctacacctaccggccgtggacgcgcggcggctcgctggagcgctcgcagtcgcgcaaggactcgctggacgacagcggcagctgcctgagcggcagccagcggaccctgccctcggcctcgccgagcccgggctacctgggccgcggcgcgccaccgccagtcgagctgtgcgccttccccgagtggaaggcgcccggcgccctcctgagcctgcccgcgcctgagccccccggccgccgcggccgccacgactcgggcccgctcttcaccttcaagctcctgaccgagcccgagagccccgggaccgacggcggcgccagcaacggaggctgcgaggccgcggccgacgtggccaacgggcagccgggcttcaaaagcaacatgcccctggcgcccgggcagttttagggcccccgtgcgcagctttctttccctggggaggaaaacatcgtgggggggaggggagggcggggcggaggggggaggggagcgtccacgccgggtagacgcgcgccccaaggggaaccggggggagggccggggagaggggcagctgcttttctggcaggggcatgggtgccaggtaccacgcggaaagccgggccgagcatgctgagag

SEQ ID NO: 125147 - DNA, 27 bp, Homo sapiens
  misc_feature 1..27: note = chr5:159437321-159437348
  misc_feature 1..27: note = Hypo
  source 1..27: mol_type = genomic DNA
cagttaaaatgacgatttgacattatt

SEQ ID NO: 125148 - DNA, 376 bp, Homo sapiens; identical to SEQ ID NO: 93221
  misc_feature 1..376: note = chr5:159615222-159615598
  misc_feature 1..376: note = Hyper
  source 1..376: mol_type = genomic DNA

SEQ ID NO: 125149 - DNA, 21 bp, Homo sapiens
  misc_feature 1..21: note = chr5:159660593-159660614
  misc_feature 1..21: note = Hypo
  source 1..21: mol_type = genomic DNA
gaaactggccgggcacggtgg

SEQ ID NO: 125150 - DNA, 28 bp, Homo sapiens
  misc_feature 1..28: note = chr5:159672080-159672108
  misc_feature 1..28: note = Hypo
  source 1..28: mol_type = genomic DNA
ggtaggggctgggtgcggtggctcacgc

SEQ ID NO: 125151 - DNA, 56 bp, Homo sapiens; identical to SEQ ID NO: 93224
  misc_feature 1..56: note = chr5:159738684-159738740
  misc_feature 1..56: note = Hyper
  source 1..56: mol_type = genomic DNA

SEQ ID NO: 125152 - DNA, 137 bp, Homo sapiens; identical to SEQ ID NO: 93225
  misc_feature 1..137: note = chr5:159739049-159739186
  misc_feature 1..137: note = Hyper
  source 1..137: mol_type = genomic DNA

SEQ ID NO: 125153 - DNA, 468 bp, Homo sapiens; identical to SEQ ID NO: 93226
  misc_feature 1..468: note = chr5:159739433-159739901
  misc_feature 1..468: note = Hyper
  source 1..468: mol_type = genomic DNA

SEQ ID NO: 125154 - DNA, 262 bp, Homo sapiens; identical to SEQ ID NO: 93227
  misc_feature 1..262: note = chr5:159776326-159776588
  misc_feature 1..262: note = Hypo
  source 1..262: mol_type = genomic DNA

SEQ ID NO: 125155 - DNA, 40 bp, Homo sapiens; identical to SEQ ID NO: 93229
  misc_feature 1..40: note = chr5:160498377-160498417
  misc_feature 1..40: note = Hypo
  source 1..40: mol_type = genomic DNA

SEQ ID NO: 125156 - DNA, 425 bp, Homo sapiens; identical to SEQ ID NO: 93230
  misc_feature 1..425: note = chr5:160973379-160973804
  misc_feature 1..425: note = Hyper
  source 1..425: mol_type = genomic DNA

SEQ ID NO: 125157 - DNA, 249 bp, Homo sapiens; identical to SEQ ID NO: 30056
  misc_feature 1..249: note = chr5:160974612-160974861
  misc_feature 1..249: note = Hyper
  source 1..249: mol_type = genomic DNA

SEQ ID NO: 125158 - DNA, 377 bp, Homo sapiens
  misc_feature 1..377: note = chr5:160975071-160975448
  misc_feature 1..377: note = Hyper
  source 1..377: mol_type = genomic DNA
ggcactgtgttctcccgcggtctccgcgccacctcgtcctcttcttcccttccccgcgcccaggggactcgcacacccagaggctgcctcttcccttcctcctgaagctcaggccgcctcgccgtggccgccgggacccggaggaggcagcaagcttggggtggggaaattgggggagggagatactcaattcacaaaagaagtcttccctccgctccagggaaagagaggagccacgggcggcgtgaggtgctacgagtctggggacacaaggccgtccgaaggaaccggagtccacaccagcggctctccgggtactcctgagtttatcttggaactggggaagaggcgggaagagtagacgttcccgctacccc

SEQ ID NO: 125159 - DNA, 330 bp, Homo sapiens
  misc_feature 1..330: note = chr5:160975668-160975998
  misc_feature 1..330: note = Hyper
  source 1..330: mol_type = genomic DNA
tgaagtcaagaagctcgcccaaggtcactcagatggcatgaggtgaaaccaggattggacttcagagccagcgttcctaaccactgaactagacagcctacactccgaagtctcctgagtcagcgaccttgcccgctgccagcgctttgctgtggcgggtcaagctcctggcgcccgaggagcccgcggcggctgcgggtggagttgagcgcggaccgcacgagctagacccggccggtgtctgcggagaggaggggtcgccggcccgcagagttggcggcaggcggcggaagtagctccacaggcttgcgaccccggcagccctggggg

SEQ ID NO: 125160 - DNA, 37 bp, Homo sapiens; identical to SEQ ID NO: 93236
  misc_feature 1..37: note = chr5:161274219-161274256
  misc_feature 1..37: note = Hyper
  source 1..37: mol_type = genomic DNA

SEQ ID NO: 125161 - DNA, 160 bp, Homo sapiens
  misc_feature 1..160: note = chr5:161274605-161274765
  misc_feature 1..160: note = Hyper
  source 1..160: mol_type = genomic DNA
ctctttcctaccatccgtcaccattcgtgactctgcaagacacggggacttagacatatgtgtgggagtgtgtgtgtgagggagagaggcgagacgagtgctctccccacacgtgtaaccctgcatctcccagtttcagagcttgcgttcattcatatgc

SEQ ID NO: 125162 - DNA, 287 bp, Homo sapiens
  misc_feature 1..287: note = chr5:161275303-161275590
  misc_feature 1..287: note = Hyper
  source 1..287: mol_type = genomic DNA
gcccctctgctctggcgcgcccggactcggactcgcagactcgcgctggctccagtctctccacgattctctctcccagacttttccccggtcttaagagatcctgtgtccagagggggccttaggtaagtgcgactttggaccacgatacacagacagagctttgaacgtggcttttcctagctggagagacaggaatgttatagtcggggggggggggcggggggagacggggggagagagagagagagagaagaaggagagcgagcgagcgagcaagggagcga

SEQ ID NO: 125163 - DNA, 58 bp, Homo sapiens; identical to SEQ ID NO: 93239
  misc_feature 1..58: note = chr5:161275813-161275871
  misc_feature 1..58: note = Hyper
  source 1..58: mol_type = genomic DNA

SEQ ID NO: 125164 - DNA, 76 bp, Homo sapiens; identical to SEQ ID NO: 93240
  misc_feature 1..76: note = chr5:161495120-161495196
  misc_feature 1..76: note = Hyper
  source 1..76: mol_type = genomic DNA

SEQ ID NO: 125165 - DNA, 30 bp, Homo sapiens; identical to SEQ ID NO: 93247
  misc_feature 1..30: note = chr5:162807006-162807036
  misc_feature 1..30: note = Hypo
  source 1..30: mol_type = genomic DNA

SEQ ID NO: 125166 - DNA, 46 bp, Homo sapiens; identical to SEQ ID NO: 93248
  misc_feature 1..46: note = chr5:162930274-162930320
  misc_feature 1..46: note = Hyper
  source 1..46: mol_type = genomic DNA

SEQ ID NO: 125167 - DNA, 805 bp, Homo sapiens; identical to SEQ ID NO: 93249
  misc_feature 1..805: note = chr5:162931152-162931957
  misc_feature 1..805: note = Hyper
  source 1..805: mol_type = genomic DNA

SEQ ID NO: 125168 - DNA, 45 bp, Homo sapiens; identical to SEQ ID NO: 93250
  misc_feature 1..45: note = chr5:163604915-163604960
  misc_feature 1..45: note = Hypo
  source 1..45: mol_type = genomic DNA

SEQ ID NO: 125169 - DNA, 149 bp, Homo sapiens; identical to SEQ ID NO: 93251
  misc_feature 1..149: note = chr5:164218749-164218898
  misc_feature 1..149: note = Hypo
  source 1..149: mol_type = genomic DNA

SEQ ID NO: 125170 - DNA, 55 bp, Homo sapiens; identical to SEQ ID NO: 93254
  misc_feature 1..55: note = chr5:165029934-165029989
  misc_feature 1..55: note = Hypo
  source 1..55: mol_type = genomic DNA

SEQ ID NO: 125171 - DNA, 28 bp, Homo sapiens
  misc_feature 1..28: note = chr5:166269144-166269172
  misc_feature 1..28: note = Hypo
  source 1..28: mol_type = genomic DNA
atctgagtcggccagcgcggtggctcac

SEQ ID NO: 125172 - DNA, 89 bp, Homo sapiens; identical to SEQ ID NO: 93258
  misc_feature 1..89: note = chr5:166363557-166363646
  misc_feature 1..89: note = Hypo
  source 1..89: mol_type = genomic DNA

SEQ ID NO: 125173 - DNA, 1007 bp, Homo sapiens; identical to SEQ ID NO: 93259
  misc_feature 1..1007: note = chr5:166405469-166406476
  misc_feature 1..1007: note = Hyper
  source 1..1007: mol_type = genomic DNA

SEQ ID NO: 125174 - DNA, 151 bp, Homo sapiens; identical to SEQ ID NO: 93260
  misc_feature 1..151: note = chr5:166461205-166461356
  misc_feature 1..151: note = Hypo
  source 1..151: mol_type = genomic DNA

SEQ ID NO: 125175 - DNA, 43 bp, Homo sapiens; identical to SEQ ID NO: 93261
  misc_feature 1..43: note = chr5:166470722-166470765
  misc_feature 1..43: note = Hypo
  source 1..43: mol_type = genomic DNA

SEQ ID NO: 125176 - DNA, 83 bp, Homo sapiens; identical to SEQ ID NO: 93262
  misc_feature 1..83: note = chr5:166532947-166533030
  misc_feature 1..83: note = Hypo
  source 1..83: mol_type = genomic DNA

SEQ ID NO: 125177 - DNA, 21 bp, Homo sapiens
  misc_feature 1..21: note = chr5:166865441-166865462
  misc_feature 1..21: note = Hypo
  source 1..21: mol_type = genomic DNA
gctggagtgcagtggcgccat

SEQ ID NO: 125178 - DNA, 30 bp, Homo sapiens; identical to SEQ ID NO: 93267
  misc_feature 1..30: note = chr5:166920753-166920783
  misc_feature 1..30: note = Hypo
  source 1..30: mol_type = genomic DNA

SEQ ID NO: 125179 - DNA, 239 bp, Homo sapiens; identical to SEQ ID NO: 93268
  misc_feature 1..239: note = chr5:167000910-167001149
  misc_feature 1..239: note = Hyper
  source 1..239: mol_type = genomic DNA

SEQ ID NO: 125180 - DNA, 30 bp, Homo sapiens; identical to SEQ ID NO: 93271
  misc_feature 1..30: note = chr5:167449482-167449512
  misc_feature 1..30: note = Hypo
  source 1..30: mol_type = genomic DNA

SEQ ID NO: 125181 - DNA, 30 bp, Homo sapiens; identical to SEQ ID NO: 93272
  misc_feature 1..30: note = chr5:167530477-167530507
  misc_feature 1..30: note = Hypo
  source 1..30: mol_type = genomic DNA

SEQ ID NO: 125182 - DNA, 99 bp, Homo sapiens; identical to SEQ ID NO: 93273
  misc_feature 1..99: note = chr5:167689244-167689343
  misc_feature 1..99: note = Hypo
  source 1..99: mol_type = genomic DNA

SEQ ID NO: 125183 - DNA, 497 bp, Homo sapiens
  misc_feature 1..497: note = chr5:167955981-167956478
  misc_feature 1..497: note = Hyper
  source 1..497: mol_type = genomic DNA
gcatagactagacttcgaggatgaacatgacattttggctctctgtgtatccccattcacactgaagaatcaacaacacttccttgctgatcaatagtcccagaactggtggcacagccaggaccgacgctgatgcttacctccccctctcctgcagcagagacgcccccgtccctgtggcccagggaagtgccagggatccctgggaaggcgggagatggggaaggggcagggtgagcgaagaggagcaggctgcgtctgcacgcgggctgggaagcggggcttccgggccgcagggtcgcggggacgggtgtgatgcaatcgcgccacagccgctgcgtcaaggggcggctccgggatgcgggcactgcggtagagcccgtcctgcccccgccgcccgccgcccgccgcccgcctccgctgctaaacccgcggacaaccgccgggacgaccacccagagccaccagagccccctgacacccgccccgaggcaccg

SEQ ID NO: 125184 - DNA, 313 bp, Homo sapiens
  misc_feature 1..313: note = chr5:167956683-167956996
  misc_feature 1..313: note = Hyper
  source 1..313: mol_type = genomic DNA
gggggcggccggggccgggggcgcggcggcggcgacggcaaggatcgcggcggcggtggacagcggcggggcggcgtggccaagagcaagagccgccgcaggaagggcgccatggtggtgtcggtggagccgcaccggcacgagggcgtcttcatctaccgcggggcggaggacgcgctggtcacgctgaacatggtgccgggccagtctgtgtacggcgagaggcgcgtcacggtgaccgagggcggcgtgaagcaggagtaccgcacgtggaacccgttccgctctaagctggccgcggccatcctgggcg

SEQ ID NO: 125185 - DNA, 166 bp, Homo sapiens; identical to SEQ ID NO: 93279
  misc_feature 1..166: note = chr5:168192155-168192321
  misc_feature 1..166: note = Hypo
  source 1..166: mol_type = genomic DNA

SEQ ID NO: 125186 - DNA, 190 bp, Homo sapiens; identical to SEQ ID NO: 93280
  misc_feature 1..190: note = chr5:168195076-168195266
  misc_feature 1..190: note = Hypo
  source 1..190: mol_type = genomic DNA

SEQ ID NO: 125187 - DNA, 57 bp, Homo sapiens; identical to SEQ ID NO: 93281
  misc_feature 1..57: note = chr5:168231749-168231806
  misc_feature 1..57: note = Hypo
  source 1..57: mol_type = genomic DNA

SEQ ID NO: 125188 - DNA, 197 bp, Homo sapiens; identical to SEQ ID NO: 93282
  misc_feature 1..197: note = chr5:168233348-168233545
  misc_feature 1..197: note = Hypo
  source 1..197: mol_type = genomic DNA

SEQ ID NO: 125189 - DNA, 30 bp, Homo sapiens; identical to SEQ ID NO: 93283
  misc_feature 1..30: note = chr5:168244450-168244480
  misc_feature 1..30: note = Hypo
  source 1..30: mol_type = genomic DNA

SEQ ID NO: 125190 - DNA, 30 bp, Homo sapiens; identical to SEQ ID NO: 93284
  misc_feature 1..30: note = chr5:168250255-168250285
  misc_feature 1..30: note = Hypo
  source 1..30: mol_type = genomic DNA

SEQ ID NO: 125191 - DNA, 74 bp, Homo sapiens; identical to SEQ ID NO: 93285
  misc_feature 1..74: note = chr5:168253292-168253366
  misc_feature 1..74: note = Hypo
  source 1..74: mol_type = genomic DNA

SEQ ID NO: 125192 - DNA, 30 bp, Homo sapiens; identical to SEQ ID NO: 93286
  misc_feature 1..30: note = chr5:168258418-168258448
  misc_feature 1..30: note = Hypo
  source 1..30: mol_type = genomic DNA

SEQ ID NO: 125193 - DNA, 278 bp, Homo sapiens; identical to SEQ ID NO: 93287
  misc_feature 1..278: note = chr5:168267858-168268136
  misc_feature 1..278: note = Hypo
  source 1..278: mol_type = genomic DNA

SEQ ID NO: 125194 - DNA, 24 bp, Homo sapiens
  misc_feature 1..24: note = chr5:168278312-168278336
  misc_feature 1..24: note = Hypo
  source 1..24: mol_type = genomic DNA
gtgagactccgtctcaaaaaaaaa

SEQ ID NO: 125195 - DNA, 43 bp, Homo sapiens; identical to SEQ ID NO: 93289
  misc_feature 1..43: note = chr5:168289177-168289220
  misc_feature 1..43: note = Hypo
  source 1..43: mol_type = genomic DNA

SEQ ID NO: 125196 - DNA, 92 bp, Homo sapiens; identical to SEQ ID NO: 93290
  misc_feature 1..92: note = chr5:168337394-168337486
  misc_feature 1..92: note = Hypo
  source 1..92: mol_type = genomic DNA

SEQ ID NO: 125197 - DNA, 114 bp, Homo sapiens; identical to SEQ ID NO: 93291
  misc_feature 1..114: note = chr5:168372951-168373065
  misc_feature 1..114: note = Hypo
  source 1..114: mol_type = genomic DNA

SEQ ID NO: 125198 - DNA, 22 bp, Homo sapiens
  misc_feature 1..22: note = chr5:168614854-168614876
  misc_feature 1..22: note = Hypo
  source 1..22: mol_type = genomic DNA
gctgcaacgataaattcttaaa

SEQ ID NO: 125199 - DNA, 998 bp, Homo sapiens
  misc_feature 1..998: note = chr5:168727355-168728353
  misc_feature 1..998: note = Hyper
  source 1..998: mol_type = genomic DNA
tacagacccccagctcggagagtgagggatcgtatccaggaagggatgagaatagagactgcatccagggaggccgaggggaaaggacggatctggcgcctggggccccctcggtgggacccaggtgggtggcccgcgtggggtggggcaggggtactcacaggcgctcagcgttgcgggggatgccccgaggaaccgcgcggaggcccagcccgtggcagtccacgctggcagcggagcaggtacacttggtggggcaggcgacggctggaggcccactcaggacgctcgccagcgccaaggccagcgccaggcgggcgcgcacggcggcgccgacccctgcccacccgggggccatggtgtgcagggccccgctcctggaggaggctgcctctgcggggcaagacgcgtggagcccgaggaggcgcgcggggagcgcgggcggcctggggagcgggcggcggagttagcgcggaggaggggcgagctcggtgctcaggcgcacggggcgcgggcggagcggggcgctccgggcggcggcggcggcagcaacagcagctccatcggcggggccggcgctgccccgctgcgcatcgctgggagtgcccaggtgcggagcgccccctggccccgctggcccgcgggccgggttggggacctggggcgagcgcaatggggcgtggcgcccggggaggtccggcttggggctgggctggggagcgcggcggctgcggctggggcacggggcggccgggtgagctggccggcgctcgctctctccattcagtgagcacggcagacaccggagacgcggggcccacccctccggcccccccccgaccaagaaacgccaactccgcctcccattggctgcgccgcgcgtcatgtcgactaagttgggaactttgctggagcgaccgagagcctggagggaggaggcagtagaggagggagagagaaggaaccagggaaggaaaggggctcggccagcagggccc

SEQ ID NO: 125200 - DNA, 41 bp, Homo sapiens; identical to SEQ ID NO: 93296
  misc_feature 1..41: note = chr5:168728570-168728611
  misc_feature 1..41: note = Hyper
  source 1..41: mol_type = genomic DNA

SEQ ID NO: 125201 - DNA, 30 bp, Homo sapiens; identical to SEQ ID NO: 93297
  misc_feature 1..30: note = chr5:168771979-168772009
  misc_feature 1..30: note = Hypo
  source 1..30: mol_type = genomic DNA

SEQ ID NO: 125202 - DNA, 797 bp, Homo sapiens
  misc_feature 1..797: note = chr5:169064008-169064805
  misc_feature 1..797: note = Hyper
  source 1..797: mol_type = genomic DNA
aactctctgcacttgcggtggtggtctggcgagccccaggtggggactggcctctgctccctcgcctggggaggagacaaagtgggagtggtccccaagttttgcgtgaagtggggtggggtggcgtgtcttagcctacggggcaccagccttctagtgtgcccctgcccaacgggagggaggagggagcggggagccccggcgagggaggagagggcgggccctgagaggagtttgaaaagaggaaggaagtggggccctgcggcgcccagccaccccctgacggcttccccacgggaggacgcgaggccccggcccagccatggccccctggcgcaaagctgacaaggagcggcacggcgtgggtaggtgcgggccccagggcgcggcagggagcgggacaggtggcgggagagccgcgagcaggaggatgctgcggggccggcggcgcggggtgggcagggcgcgctgcctgcaggtcagagggcgcagcctgcggcggggcctcggggcgggaaagccgaggctcggggagaggacggcgggaccccaccccgcaggctaagcacagccctcgccctctcgcctgctgagggaaccttagacatttccgagatagggtcaagacctgcgcttgacaactcagttcttcgcgccaaactcggcgtccccaggagtgccccagctcgccgcgtgggagacttggccttgtagagggagctccactctcccctggctcagccttggcctgcccaccatgcatacttccaccccctccaaagcgacacccatttgcc

SEQ ID NO: 125203 - DNA, 30 bp, Homo sapiens; identical to SEQ ID NO: 93300
  misc_feature 1..30: note = chr5:169127084-169127114
  misc_feature 1..30: note = Hypo
  source 1..30: mol_type = genomic DNA

SEQ ID NO: 125204 - DNA, 102 bp, Homo sapiens; identical to SEQ ID NO: 93301
  misc_feature 1..102: note = chr5:169157436-169157538
  misc_feature 1..102: note = Hypo
  source 1..102: mol_type = genomic DNA

SEQ ID NO: 125205 - DNA, 30 bp, Homo sapiens; identical to SEQ ID NO: 93302
  misc_feature 1..30: note = chr5:169158556-169158586
  misc_feature 1..30: note = Hypo
  source 1..30: mol_type = genomic DNA

SEQ ID NO: 125206 - DNA, 30 bp, Homo sapiens; identical to SEQ ID NO: 93303
  misc_feature 1..30: note = chr5:169165242-169165272
  misc_feature 1..30: note = Hypo
  source 1..30: mol_type = genomic DNA

SEQ ID NO: 125207 - DNA, 194 bp, Homo sapiens; identical to SEQ ID NO: 93304
  misc_feature 1..194: note = chr5:169323759-169323953
  misc_feature 1..194: note = Hypo
  source 1..194: mol_type = genomic DNA

SEQ ID NO: 125208 - DNA, 223 bp, Homo sapiens; identical to SEQ ID NO: 93309
  misc_feature 1..223: note = chr5:169532899-169533122
  misc_feature 1..223: note = Hypo
  source 1..223: mol_type = genomic DNA

SEQ ID NO: 125209 - DNA, 175 bp, Homo sapiens; identical to SEQ ID NO: 93310
  misc_feature 1..175: note = chr5:169655548-169655723
  misc_feature 1..175: note = Hypo
  source 1..175: mol_type = genomic DNA

SEQ ID NO: 125210 - DNA, 143 bp, Homo sapiens; identical to SEQ ID NO: 40633
  misc_feature 1..143: note = chr5:169658356-169658499
  misc_feature 1..143: note = Hypo
  source 1..143: mol_type = genomic DNA

SEQ ID NO: 125211 - DNA, 51 bp, Homo sapiens; identical to SEQ ID NO: 40634
  misc_feature 1..51: note = chr5:169660169-169660220
  misc_feature 1..51: note = Hypo
  source 1..51: mol_type = genomic DNA

SEQ ID NO: 125212 - DNA, 96 bp, Homo sapiens; identical to SEQ ID NO: 93313
  misc_feature 1..96: note = chr5:169660603-169660699
  misc_feature 1..96: note = Hypo
  source 1..96: mol_type = genomic DNA

SEQ ID NO: 125213 - DNA, 40 bp, Homo sapiens; identical to SEQ ID NO: 93314
  misc_feature 1..40: note = chr5:169866477-169866517
  misc_feature 1..40: note = Hypo
  source 1..40: mol_type = genomic DNA

SEQ ID NO: 125214 - DNA, 154 bp, Homo sapiens; identical to SEQ ID NO: 93315
  misc_feature 1..154: note = chr5:169877679-169877833
  misc_feature 1..154: note = Hypo
  source 1..154: mol_type = genomic DNA

SEQ ID NO: 125215 - DNA, 82 bp, Homo sapiens; identical to SEQ ID NO: 93316
  misc_feature 1..82: note = chr5:169930863-169930945
  misc_feature 1..82: note = Hyper
  source 1..82: mol_type = genomic DNA

SEQ ID NO: 125216 - DNA, 293 bp, Homo sapiens
  misc_feature 1..293: note = chr5:169931191-169931484
  misc_feature 1..293: note = Hyper
  source 1..293: mol_type = genomic DNA
cggcggctcccgcaccgcacgcggcgctggctcggcagcctcggccgggcggccgctctggccccgtgtccagtgccaggcaggcttcagggcaccgtcctcggccctgggcgagggaaccgccgggccgggtcctcgcgcggggaagcggttccgaaggctcgcggggagcggctagccctgagtccctgcatgtgcggggctgaagaaggaagccagaagcctcctagcctcgcctccacgcttgctgaataccaagctgcaggcgagctgccgggcgcttttctctcctc

SEQ ID NO: 125217 - DNA, 30 bp, Homo sapiens; identical to SEQ ID NO: 40635
  misc_feature 1..30: note = chr5:169932029-169932059
  misc_feature 1..30: note = Hypo
  source 1..30: mol_type = genomic DNA

SEQ ID NO: 125218 - DNA, 30 bp, Homo sapiens; identical to SEQ ID NO: 93320
  misc_feature 1..30: note = chr5:170028243-170028273
  misc_feature 1..30: note = Hypo
  source 1..30: mol_type = genomic DNA

SEQ ID NO: 125219 - DNA, 483 bp, Homo sapiens; identical to SEQ ID NO: 30084
  misc_feature 1..483: note = chr5:170107959-170108442
  misc_feature 1..483: note = Hyper
  source 1..483: mol_type = genomic DNA

SEQ ID NO: 125220 - DNA, 41 bp, Homo sapiens; identical to SEQ ID NO: 93322
  misc_feature 1..41: note = chr5:170171099-170171140
  misc_feature 1..41: note = Hyper
  source 1..41: mol_type = genomic DNA

SEQ ID NO: 125221 - DNA, 30 bp, Homo sapiens; identical to SEQ ID NO: 93323
  misc_feature 1..30: note = chr5:170171383-170171413
  misc_feature 1..30: note = Hyper
  source 1..30: mol_type = genomic DNA

SEQ ID NO: 125222 - DNA, 90 bp, Homo sapiens
  misc_feature 1..90: note = chr5:170289230-170289320
  misc_feature 1..90: note = Hyper
  source 1..90: mol_type = genomic DNA
tgcacaccccaggcccgggccggagcccgagaaaggggcggccgagcctgggttggaggcggcgggtggagggggcgggggacaggccca

SEQ ID NO: 125223 - DNA, 32 bp, Homo sapiens; identical to SEQ ID NO: 93324
  misc_feature 1..32: note = chr5:170289702-170289734
  misc_feature 1..32: note = Hyper
  source 1..32: mol_type = genomic DNA

SEQ ID NO: 125224 - DNA, 30 bp, Homo sapiens; identical to SEQ ID NO: 93326
  misc_feature 1..30: note = chr5:170675080-170675110
  misc_feature 1..30: note = Hypo
  source 1..30: mol_type = genomic DNA

SEQ ID NO: 125225 - DNA, 35 bp, Homo sapiens; identical to SEQ ID NO: 93327
  misc_feature 1..35: note = chr5:170687481-170687516
  misc_feature 1..35: note = Hypo
  source 1..35: mol_type = genomic DNA

SEQ ID NO: 125226 - DNA, 21 bp, Homo sapiens
  misc_feature 1..21: note = chr5:170717082-170717103
  misc_feature 1..21: note = Hypo
  source 1..21: mol_type = genomic DNA
atgactcgggccagacgcagt

SEQ ID NO: 125227 - DNA, 60 bp, Homo sapiens; identical to SEQ ID NO: 93329
  misc_feature 1..60: note = chr5:170733836-170733896
  misc_feature 1..60: note = Hyper
  source 1..60: mol_type = genomic DNA

SEQ ID NO: 125228 - DNA, 2199 bp, Homo sapiens
  misc_feature 1..2199: note = chr5:170737778-170739977
  misc_feature 1..2199: note = Hyper
  source 1..2199: mol_type = genomic DNA
gcactctccttctcctccttcttccagcccgccctctcggattttcaacaatcctcgtggacgccggtttcctctccccccatctccgcgtctccattccagccgcgtttttatccgatctctgttttgattcaacccgtaaacggcgaagcgatcgcgtctggaaaggggttcaagacaggccctgggcgaactggatgagactgacccagcccccgggcgtcgtgcgggtggtgcagagccagcctgctcacccgcggaccccagcgaccccggttcccgcagggccaagtcagttacacataggccctgcccttgctatctggcgaaaggaacaatctttattgttggtgaagccacaatacccgggcgtgcaggtgggcggcgggcagagtcccctcctggagaccctctggcacacaacaaaaacaaatgatcctaaccggctccctggatataagagcctcgggcgtaaagcgcgggctgggaggcagacgggttctgcgcctcgaggctcccggatggcctcggctcccgggagggccggggccccgccggcggccccgcggtgccgggtgcatgacggtactgtccctctccctcccccggtgcaggcggcagacggcggaggagcgggaggcggagcggcagcaggcgagccggctcatgctgcagctgcaacacgacgccttccaaaagagcctcaacgactccatccagcctgacccgctctgtctgcacaactcgtcactctttgctctgcagaatctgcagccctgggaggaggatagttccaaggttcccgctgtcacctccctggtgtgagcccaccagcgcgcaccgtcgccacggatcgccgcccccacccagccgggcgccccggaccccccaggcgggctgcgggggaaccggcgccgagaggggaaggggccgcctagcccgagtaggccccagggcgcggccacagactggcgggccgcggaagggggtagggcccgagctccgcgcggccgcacaatccgagcccccgccccgcgccccgtcccgccccaggcccgggcctgacaagaaagcgccttacgtttctccgccccccgcccgcaccccccgggccgggcgcctgtattatactttgtacttttgcccaaacgtgtaaataataaaaaagttttggcttttttctttagaaaccggccacctgcttcccccgcgggggccgctggaggaagggcagccgacccggccgctgggggaagtgccaggggcccggggcaccctgcgtttaggctgggtccactcttcttcttttccgttccttttatttaagtctttttatttaataaaaaagttagctatttcacttaacgccgcttttatttcgttttcgttccaataatgctcggcgacccccggccctgcgccccacccctgcggcggtagaagccgagcggcggcgcgcagggcgcgtccacttccgcaacgttcgtctgcattcgcctcggctgcaaccccggcccgggcccccgaggaggatgcgcggtgcaggtcagttggtgccggccacccgcagcctgggtgcgcacgggatggggactggacatgggaaaggtgctccaggcccgaaggccgcgggccagcgccggggcgggctggggagtgaaaggctgggcctgggcagatgcctaggccgtccccaggtcaaatccacctggggggtgggaggcagggtggcctcgaacttcttagagctcaagtcggaactcggagccccacttcaccccgcaactcgctttccgccctctttttcccgcggagcctcagagaggacctggctctggccagtctgcgcgcgctgtgggcaggctttgcgcgcagagccgctgcaaatcctcggtctccaaacgcctggggagcaaatgcagcgcacaaccctaggggccctctccttgtcgggtttgcgtgggaccccaggtggagcgtgacgtcatgtgacgtcaccgcagcccccgcggtgtcactgggctggagtgggcggggcgcccggaactcagaactctaagcgctggtgtggtagcgtcgtggccggggtccacccagctccaccgtggctcaagagctggaagtttcagaattgcgaggtttggagcggctgaccccttccagtcacatctaacacacaaagcccgtgaacacttcctc

SEQ ID NO: 125229 - DNA, 2619 bp, Homo sapiens
  misc_feature 1..2619: note = chr5:170735099-170737718
  misc_feature 1..2619: note = Hyper
  source 1..2619: mol_type = genomic DNA
agagtttgcacctaacgattttagaattcgctggaagaaaatgattccgcttgtctccccaaagctgcagcggaaggtgactacttcgtgtgcggtcctgtccacggtgccctgggccgggtagacagtcactgaggcgcgagcagaacggggagtggttccagcgcccaaagtggactggagccgggaagggctcaccagtcgcgtttcccaaagaaatcccgcaatttgctctaggagctgcccgcgcctttgacattcaggaacccgaagtccctagacccgccgagccgcgagcgggttcccacgcgcgaccacagcccccttccatcctgcaacgaattacgagagtcaggtccccgctccccaccgggcgaccccgcgtccctagcccagccgcagctggcacgcgtgggcacctgcgagtcacgcctcggtccgcctggccggagccagggagtgtctccaaagtggccgcgaggccgcggccgaaacccgggcgggggcgaattctccccacgcgggtcggcgtcatccggggcgcggagaacgctacggtgctcccctcgccccgcgcgcaggcagcgcgaagcctgccccgggtagtgcgcccctttcgttcctccggcggcggtagcgtccaaggggcttctgcggattccgccgggtcgtcccggggttgcaactccattgtacctgaaaggatgcatttggtttggcttttgctcagatgaaaaaaaaaaaaaattggaagaaaacgaaaacccactcagcaaaagacaatttcacaagcggagcgctctacccacccagcgcggtgtctgggaagcggcccggcccggaggagcggggagcgtctgctaattgcagcttcgttagatttcgggtttgggaggctgtggttcgggctctaatatccgccgcccattatccctgctaataaatttgacctattgttcgtttgttaaaatgatgtcaccttggaacagtccctaagctcctatttccatgaattaggcctttattgaaagccgggagccaatgagaggagagaggcttgttgatcgcagccaatggctgcggcaggagaggaattagcagcggaaactccaggttcggttcaagaaagatgacacagagcctgtcgggcccgcgcactcttggcaaagtttcagtgcgacgagaggcgccgggcgctccatggccgcgccgtaacggggacccagccgcctccccgcccagcccagcccagcccttccgcccgcccaggatggaggcgcccgccagcgcgcagaccccgcacccgcacgagcccatcagcttcggcatcgaccagatccttaacagcccggaccaggacagcgcacccgccccgcggggccccgacggcgccagctacctgggagggccccccgggggccgtccgggcgccacatacccgtctctgcccgcctcctttgcgggcctcggcgcgcccttcgaggacgcgggatcttacagtgtgaacctgagcctagcgcccgcaggcgtgatccgggtgccggcgcacaggccgctgcccggggccgtgccaccgcctctgccaagcgcgctacccgccatgccctccgtgcccacggtctccagccttggcggtctcaatttcccctggatggagagcagccgccgcttcgtgaaagaccgcttcacaggtgagcagagctggcgaccaggctccaggcctccgccctctcggggccagaggcgccgcgccctgtgcgctccactcccggaaaccatttcagaggcccaagcgcggcggaggcctcggccccagggccccgggcagccgtggtggggagggtaatcggagagttgcaggaaaataagcccgtgcccgggggaagggacagggggcgagggggtctcccgaccggcttggtgtctctggaaacgcgcgcgaccagcgaaatagcggagctctccgtgtcccacggggcgccacggggtccgcatggggcctgaacggtggcggagccgggctgggcttcaggggccctcctgtgtctccgcagcggcggccgcactcacgcccttcaccgtgacccggcgcatcggccacccctaccagaaccggacgccgcccaagcgtaagaagccgcgcacgtccttttcccgggtgcagatctgcgagctggaaaagcgcttccatcgccagaagtacctggcctctgccgagagggcggcgctcgccaagtccctcaaaatgacggacgcgcaggtcaagacctggttccaaaaccggaggaccaagtggcggtgagagaggcctgacccggcccaccttacacctgcccttcacctgtcccgccccgagccgcagcctcgcactagccctattttaaggctatccactacccccgcccccctctgcctcccccaaacacacccccaccccgccttcgcagattgtacctcttcctttcacccttctcgctggcctgtgcttctctctccatcgtggtctcccacgccttggtttctcctccatccccatccccatctttcgtgagcccctccaactctctccccgtgttttgtacggtctcctgcgttcacttgatttcctctcacccaccc

SEQ ID NO: 125230 - DNA, 139 bp, Homo sapiens; identical to SEQ ID NO: 93337
  misc_feature 1..139: note = chr5:170740191-170740330
  misc_feature 1..139: note = Hyper
  source 1..139: mol_type = genomic DNA

SEQ ID NO: 125231 - DNA, 660 bp, Homo sapiens
  misc_feature 1..660: note = chr5:170740390-170741050
  misc_feature 1..660: note = Hyper
  source 1..660: mol_type = genomic DNA
tctcttctttcctttctccctgactccctctctccctcttccaggcccagctcccagtagctcctaaggcaaaacactttcggggccgcgtcccagagcacccctcccactccacgagcacccccacccgcctcatcccactgcctccctcggagccggagccgtgcgccaccctgcaggttcccgtgctccgagccttcgttctatgcgggctgcgggactgtattcacctgcagggctggaggaaggggagggcgcctgagaaacaccttgaacccccagcgctcccgccgtcacctccacctccaagcccagctagcctgggatctgcgcctttcaggacataaagacacccagggagggactagggtgactcagaacttcgggtctcttccgtgagtgttttcctgaaatgcttttattttctccaataaaaagcctgatgaacgccgtcatcgggttgggaaaggttggcccttcggctgaggactagagggacccttgactttgctggcggagaagcgctttcctcagagacgggtgtcgcggtccagctcccttccgttccgttttattctgttgctccataataaggcctagcggggttttttttcttaattgtttttatttcaacgcgcttttggggaacagatggtcagg

SEQ ID NO: 125232 - DNA, 1380 bp, Homo sapiens
  misc_feature 1..1380: note = chr5:170741470-170742850
  misc_feature 1..1380: note = Hyper
  source 1..1380: mol_type = genomic DNA
ggattacaggcgtgagcccccgcccccggcccaacgtatcattcttataaggcctagtatttttgtttttcaaaattacttctgttgttttgccagggtgacactcaattctttgggcctctttggagacacacgcacgttgtttttttttctttctgttgggcgcctcgctttgcgcagaaggcctctggcccggaggcccgtccggggtaggcgtccaggcaggccgggggtggggggccggtctggcttcggccctcggggggcgcctggctttcccgcacctagtgccttcgcggcgtttggcgtcttccagcgctttgccctcacccagccttgcccagccagagacgggctacgggtcttttcctgttacagagctgagcccactcatgtggtgccaagtagcgactatctctcggccacctccacccagagcaatgtgggcgcccccagcgggtgggagcgattgccgagcggcgcaagggcgtttaacgcctaaccccctcctcctgggttgccaagccgctaggtcgccgtttccaacgtggctgcgcgggactgaagtccgacgactcctcgtcctcagtaggagacacacctcccactgcccccagccacgcgagctatgggcagaatcggggcaacggtaatatctggatggggcaggctcccctgaggctgtgcttaagaaaaaaggaatctggagtagcctgaggggccccacgagggggcctcctttgcgatcgtctcccagccttaggccaaggctacggaggcaggcggccgagtgttggcgcccagcccggccgaggactggatggaggacgagaagcagcctgcctctgggcgacagctgcggacgcagcctcgccgcctcgccgcctcagcctcggtcccagcgtctctaaagccgcgcccattttacagatgcagggcagggagacaagaggcatctccgggggccgagtagaatgatggcgcgggttctcccggcgccctgatttcgaggctgcgcccggggccctacatgcaggcggggaggcctgggccgaaggcgtctgcaaggaggggcgagtctgcccggtccgggcagggagtgaggccacagtcagttctccctaggaggccgcgcagcgggtagggtatgggactgggggacgcaacggggacctggccgaatcagagccctcagcagagaacgccgaaaactctggggccggccgctcgcttcccgctagtgggaatggtttccggtcatccgttcccagtccagccccgggtagggagctctgatttgcaatgcacagcacttgcgaggttcgaatgcccccgcaatttgcagatggaaatactaagcctaggccgggcgtggtggct

SEQ ID NO: 125233 - DNA, 978 bp, Homo sapiens
  misc_feature 1..978: note = chr5:170743150-170744128
  misc_feature 1..978: note = Hyper
  source 1..978: mol_type = genomic DNA
caaagaagctctgataatagttctgggtcgtgcagcggtggcggccccgcgctctcgcccctaaagcaagcgctctttgtactgggtggaggagctttgagtagtgagggtggagatgcagcttcggggtggcgcagccaccctgacactaggcccggggtcgcagtgggacagaagagtctgccgctctgacttgggctctgagttccaagggcgcccggcacttctagcctcccaggcttgcgcgctggcgcctttgccatccgtgccgaagtggggagacctagccgcgaccaccacgagcgcagcggtgacacccagaggtcccaccgggcccctgggcagggtaaccttagcctgtccgcttcggcagctttgcgaagagtggcgcgcagctagggctgaggctcttgcggacctgcggtcgaagcaggcggctgagccagttcgatcgccaaggcctgggctgccgacagtggtgcgcgctctgttccgccgcggccgggccaggcgctctggaatagcgatggggggacacggcctccaactttctgcagagaccatcgggcagctccgggcctaagcagcgacctcaccgaaggttcctgggaacctttgccaaaatcccagcctctgcctcggtccagctaaaccgtgtgtaaacaagtgcaccaaggccgcagagcggctggtgtggtgcaggcgcctgcgttctggagtagtgaaggttcctccacagggaaggcggttttccttccgtgaaattcgaaattcagccccccagttccaagcgcctgctccgttaatagcatctactctcagcgacgcccagacccaggctgtgcactgtcttggctcagacactggcaaagtcctcgagaaattgccttggtgatcggtgccttccctcgggccacccagccgccggtggcacggagtcttccgcgcagttgtgcggaccctcgctgtgtggccctg

SEQ ID NO: 125234 - DNA, 187 bp, Homo sapiens; identical to SEQ ID NO: 93346
  misc_feature 1..187: note = chr5:170744375-170744562
  misc_feature 1..187: note = Hyper
  source 1..187: mol_type = genomic DNA

SEQ ID NO: 125235 - DNA, 381 bp, Homo sapiens; identical to SEQ ID NO: 93347
  misc_feature 1..381: note = chr5:170745099-170745480
  misc_feature 1..381: note = Hyper
  source 1..381: mol_type = genomic DNA

SEQ ID NO: 125236 - DNA, 30 bp, Homo sapiens; identical to SEQ ID NO: 93348
  misc_feature 1..30: note = chr5:170749758-170749788
  misc_feature 1..30: note = Hypo
  source 1..30: mol_type = genomic DNA

SEQ ID NO: 125237 - DNA, 30 bp, Homo sapiens; identical to SEQ ID NO: 93349
  misc_feature 1..30: note = chr5:170763990-170764020
  misc_feature 1..30: note = Hyper
  source 1..30: mol_type = genomic DNA

SEQ ID NO: 125238 - DNA, 30 bp, Homo sapiens; identical to SEQ ID NO: 93350
  misc_feature 1..30: note = chr5:170786850-170786880
  misc_feature 1..30: note = Hypo
  source 1..30: mol_type = genomic DNA

SEQ ID NO: 125239 - DNA, 41 bp, Homo sapiens; identical to SEQ ID NO: 40636
  misc_feature 1..41: note = chr5:170811632-170811673
  misc_feature 1..41: note = Hypo
  source 1..41: mol_type = genomic DNA

SEQ ID NO: 125240 - DNA, 23 bp, Homo sapiens
  misc_feature 1..23: note = chr5:170813569-170813592
  misc_feature 1..23: note = Hypo
  source 1..23: mol_type = genomic DNA
caacacagcgagactctgtctcc

SEQ ID NO: 125241 - DNA, 109 bp, Homo sapiens; identical to SEQ ID NO: 93353
  misc_feature 1..109: note = chr5:170847266-170847375
  misc_feature 1..109: note = Hyper
  source 1..109: mol_type = genomic DNA

SEQ ID NO: 125242 - DNA, 30 bp, Homo sapiens
  misc_feature 1..30: note = chr5:170847714-170847744
  misc_feature 1..30: note = Hyper
  source 1..30: mol_type = genomic DNA
gccggcgggctcagccgcaacaatataccc

SEQ ID NO: 125243 - DNA, 41 bp, Homo sapiens
  misc_feature 1..41: note = chr5:170848044-170848085
  misc_feature 1..41: note = Hyper
  source 1..41: mol_type = genomic DNA
aggtggtgcagccctcgttggttccccgcctgctcccggtt

SEQ ID NO: 125244 - DNA, 71 bp, Homo sapiens; identical to SEQ ID NO: 40637
  misc_feature 1..71: note = chr5:170919575-170919646
  misc_feature 1..71: note = Hypo
  source 1..71: mol_type = genomic DNA

SEQ ID NO: 125245 - DNA, 143 bp, Homo sapiens; identical to SEQ ID NO: 93357
  misc_feature 1..143: note = chr5:171021838-171021981
  misc_feature 1..143: note = Hypo
  source 1..143: mol_type = genomic DNA

SEQ ID NO: 125246 - DNA, 30 bp, Homo sapiens; identical to SEQ ID NO: 93358
  misc_feature 1..30: note = chr5:171239105-171239135
  misc_feature 1..30: note = Hypo
  source 1..30: mol_type = genomic DNA

SEQ ID NO: 125247 - DNA, 66 bp, Homo sapiens; identical to SEQ ID NO: 40638
  misc_feature 1..66: note = chr5:171247586-171247652
  misc_feature 1..66: note = Hypo
  source 1..66: mol_type = genomic DNA

SEQ ID NO: 125248 - DNA, 30 bp, Homo sapiens; identical to SEQ ID NO: 93360
  misc_feature 1..30: note = chr5:171263972-171264002
  misc_feature 1..30: note = Hypo
  source 1..30: mol_type = genomic DNA

SEQ ID NO: 125249 - DNA, 83 bp, Homo sapiens; identical to SEQ ID NO: 93361
  misc_feature 1..83: note = chr5:171382147-171382230
  misc_feature 1..83: note = Hypo
  source 1..83: mol_type = genomic DNA

SEQ ID NO: 125250 - DNA, 39 bp, Homo sapiens; identical to SEQ ID NO: 40639
  misc_feature 1..39: note = chr5:171533619-171533658
  misc_feature 1..39: note = Hypo
  source 1..39: mol_type = genomic DNA

SEQ ID NO: 125251 - DNA, 76 bp, Homo sapiens; identical to SEQ ID NO: 93363
  misc_feature 1..76: note = chr5:171708301-171708377
  misc_feature 1..76: note = Hypo
  source 1..76: mol_type = genomic DNA

SEQ ID NO: 125252 - DNA, 30 bp, Homo sapiens; identical to SEQ ID NO: 93365
  misc_feature 1..30: note = chr5:172074582-172074612
  misc_feature 1..30: note = Hypo
  source 1..30: mol_type = genomic DNA

SEQ ID NO: 125253 - DNA, 30 bp, Homo sapiens; identical to SEQ ID NO: 93369
  misc_feature 1..30: note = chr5:172189170-172189200
  misc_feature 1..30: note = Hypo
  source 1..30: mol_type = genomic DNA

SEQ ID NO: 125254 - DNA, 30 bp, Homo sapiens; identical to SEQ ID NO: 93371
  misc_feature 1..30: note = chr5:172204547-172204577
  misc_feature 1..30: note = Hyper
  source 1..30: mol_type = genomic DNA

SEQ ID NO: 125255 - DNA, 120 bp, Homo sapiens; identical to SEQ ID NO: 93372
  misc_feature 1..120: note = chr5:172235653-172235773
  misc_feature 1..120: note = Hypo
  source 1..120: mol_type = genomic DNA

SEQ ID NO: 125256 - DNA, 36 bp, Homo sapiens; identical to SEQ ID NO: 93373
  misc_feature 1..36: note = chr5:172384947-172384983
  misc_feature 1..36: note = Hypo
  source 1..36: mol_type = genomic DNA

SEQ ID NO: 125257 - DNA, 96 bp, Homo sapiens; identical to SEQ ID NO: 93374
  misc_feature 1..96: note = chr5:172385283-172385379
  misc_feature 1..96: note = Hypo
  source 1..96: mol_type = genomic DNA

SEQ ID NO: 125258 - DNA, 157 bp, Homo sapiens; identical to SEQ ID NO: 93375
  misc_feature 1..157: note = chr5:172386958-172387115
  misc_feature 1..157: note = Hyper
  source 1..157: mol_type = genomic DNA

SEQ ID NO: 125259 - DNA, 736 bp, Homo sapiens; identical to SEQ ID NO: 30104
  misc_feature 1..736: note = chr5:172655825-172656561
  misc_feature 1..736: note = Hyper
  source 1..736: mol_type = genomic DNA

SEQ ID NO: 125260 - DNA, 862 bp, Homo sapiens
  misc_feature 1..862: note = chr5:172659392-172660254
  misc_feature 1..862: note = Hyper
  source 1..862: mol_type = genomic DNA
acaaactctcccgtgcgcaagaacaaacgcgcgtgggacagaaaaagttcctaggtctccgcaggagtgaatgcaaaatccaggggactcagggtcatgttgggagccccttctccccccgagagtcagggagctgttgaggtgggatcggtcagggtcgcgccacgcgggtcccttccctaccaggctcggataccatgcagcgtggacactcccgagttgctctgcggaatcccggggctctgaaccgcattcaagtccccgacgccgaagttcacgaagttgttgttggcggcggcagtggccggctgcgctggggaaggcccggcggggtaagcggcagtgcagctgtagccagggctgcaggccgcgccgccgtaacccggataggcggggtaggcgttataaccgtagggattgaggcccacgccgtaggcaggcgcgtagggcgccgagtcccctaggcatggcttgccatcgcgcaccagcactggcaccgcgatcctgcgggcaggcggcggcggcggcgggggcagccccaccagctccagagtctggtcctgccgctgccgcttgcacttgtagcgccggttctggaaccagatcttgacctgcgtggacgtgagtttcagcacgctggccagctggtcgcgttcgggggccgacaggtaccgctgctgcttgaagcgccgctccagctcatagacctgcgcctgcgagaagagcacgcgcggcttcctccgccgtcgcgcccggggccgctccgcgttgtccgcctctgtcttctccagctccaccgccttctgcagcgcgcacagctctgagggggaacagagaggcagagagacgcttggtaagagcg

SEQ ID NO: 125261 - DNA, 39 bp, Homo sapiens; identical to SEQ ID NO: 93379
  misc_feature 1..39: note = chr5:172660469-172660508
  misc_feature 1..39: note = Hyper
  source 1..39: mol_type = genomic DNA

SEQ ID NO: 125262 - DNA, 578 bp, Homo sapiens
  misc_feature 1..578: note = chr5:172660568-172661146
  misc_feature 1..578: note = Hyper
  source 1..578: mol_type = genomic DNA
gggtgaactgaattagggctagtttggtttgagaagttaaatgaacagaggccgaggcctcactgctagggacggtcttatctcaaaattaaggaatcaagaaacagaaggccagggagtgttggtttggtgatcggaggctccagcctggccgcagcagggtttgcgcagtgtccaagaagctgcgggtgggcaggcggcctcggaacctgccttgctggcttcctcgaattggtagcgatcagttctagccgccgtgcccgcccgaatttgttcccaggcctctgctcctcaacaaacctatgaattctctcccggctggcagcggcccttcgcccagcgcttcgcccagcgcctgcggcctcccgggaatcgcccgggctcctgccttgggctggggggtctcccagaaggcccctttctgcagcggggccggcctccctccccgatcctgggatggcctgcgggatgatcccgcactcatctcgtccactcccttgtgcccgcggtagcgcagcatttcctaacttttccacgagggaacctctccgccctggccgcgccggcaagttgtgctg

SEQ ID NO: 125263 - DNA, 856 bp, Homo sapiens; identical to SEQ ID NO: 30109
  misc_feature 1..856: note = chr5:172661471-172662327
  misc_feature 1..856: note = Hyper
  source 1..856: mol_type = genomic DNA

SEQ ID NO: 125264 - DNA, 30 bp, Homo sapiens; identical to SEQ ID NO: 93383
  misc_feature 1..30: note = chr5:172663838-172663868
  misc_feature 1..30: note = Hyper
  source 1..30: mol_type = genomic DNA

SEQ ID NO: 125265 - DNA, 387 bp, Homo sapiens; identical to SEQ ID NO: 30110
  misc_feature 1..387: note = chr5:172664210-172664597
  misc_feature 1..387: note = Hyper
  source 1..387: mol_type = genomic DNA

SEQ ID NO: 125266 - DNA, 501 bp, Homo sapiens; identical to SEQ ID NO: 93385
  misc_feature 1..501: note = chr5:172665448-172665949
  misc_feature 1..501: note = Hyper
  source 1..501: mol_type = genomic DNA

SEQ ID NO: 125267 - DNA, 1082 bp, Homo sapiens
  misc_feature 1..1082: note = chr5:172670755-172671837
  misc_feature 1..1082: note = Hyper
  source 1..1082: mol_type = genomic DNA
gtatgtttcccaacccgaatttgtcctggattagtggatatgatccgctttcaaactagtgttagggtttgcctcggattccgaggatccgagggagtcgctttcagacttccggtgtcctttcgcgttaatttcgtcctcttttcttctctgggctggggctggtggctgccacatcccaccccttctgccccgacggctgcaaaccgcttcagccaaaacgggcggagaggcggagagaatcgagacgctggaatcagttcctcggagtcccgtcgctggaggtcacagctgggaaaatcaggtgacattcgagtcagatggacaacgactcagatacagtgaagaggaaaatggttgtcctggggctggttcgcgcctgcccggcgggtgtgaagcccggggaaccgcgactttggaagaaccttcggcttggcggttcaggtttgggaaaagagagctggcgaactgccgcctgtttttgtgcccgcgcgggggaccagccgggccgacggcagcgctgcgggtgggttgggtcgtcggccgccgctccccggagaggtgaagagtcgcacctaccaccgggcagcctccgcggctctggccgaaaccccggctggccgcagctccgggagcccccagccctgtgctgctgcggccggctcagtgctgaattgatgctggaaacggctggccagcgggcctagggtcgccgcctttccctcctcgcctcttccttccttccgggtcgtgccctccaacctgctgtgcgttaccgcagccaagtttccaccgcccggcggagcgcattgtgaacagcagctgacaaattgttgtgttgcacacacacaccaaaaaaacccattcagtctcgtataattcggcgcaagcggtgtctgtggagagcctcccgggggcatggcacgggggacccggaggccaacaagctgcgcgataccggagcaaagtcgggatcagcagccgcctttcgcggagggcgttctgcgctccaagcaaattggcgaaatgcggggattcagacacgaaacgagcgcgctagaaagggtcgtgttgacacatcc

SEQ ID NO: 125268 - DNA, 40 bp, Homo sapiens; identical to SEQ ID NO: 93390
  misc_feature 1..40: note = chr5:172672286-172672326
  misc_feature 1..40: note = Hyper
  source 1..40: mol_type = genomic DNA

SEQ ID NO: 125269 - DNA, 448 bp, Homo sapiens
  misc_feature 1..448: note = chr5:172672668-172673116
  misc_feature 1..448: note = Hyper
  source 1..448: mol_type = genomic DNA
ctccgcgtttcctgtcgggagaggagtatcagcgcgcgcaccaaatctgctctggtatgtcaccttatctctcgtccccgctgttgtccccaaacgccgcctgtcaaaggagacgccacccgcattaggacctagactggggcccttccgctcggggtcaggcgcagcgccctcggcttgggccccgccgcccctttaggggtccgggagggtggagagaaggggcgggagccaggatgagggtgcggggggcctagaacccgaggctggtaggagagcaaactctcaaacgcgctgaaaccggcccatctgggagaaatattagggcgcatgtctctcccggagggcttccttttttttttttttcctaaccacgaaaatagggaatctttgttacaggctagttgtgagcgaatcctcctttgtccgcgtccggaggaaaatcagg

SEQ ID NO: 125270 - DNA, 30 bp, Homo sapiens; identical to SEQ ID NO: 93393
  misc_feature 1..30: note = chr5:172695117-172695147
  misc_feature 1..30: note = Hypo
  source 1..30: mol_type = genomic DNA

SEQ ID NO: 125271 - DNA, 205 bp, Homo sapiens; identical to SEQ ID NO: 93394
  misc_feature 1..205: note = chr5:172704334-172704539
  misc_feature 1..205: note = Hypo
  source 1..205: mol_type = genomic DNA

SEQ ID NO: 125272 - DNA, 109 bp, Homo sapiens; identical to SEQ ID NO: 30117
  misc_feature 1..109: note = chr5:172710849-172710958
  misc_feature 1..109: note = Hyper
  source 1..109: mol_type = genomic DNA

SEQ ID NO: 125273 - DNA, 30 bp, Homo sapiens; identical to SEQ ID NO: 93396
  misc_feature 1..30: note = chr5:172726483-172726513
  misc_feature 1..30: note = Hypo
  source 1..30: mol_type = genomic DNA

SEQ ID NO: 125274 - DNA, 1577 bp, Homo sapiens
  misc_feature 1..1577: note = chr5:172754086-172755663
  misc_feature 1..1577: note = Hyper
  source 1..1577: mol_type = genomic DNA
cccagcatgtggaggcgacaggatccgtaagaccccacgcgccgccggggcaggaccgcacagggccgccattcactcacttggggcgtccctaatgggcactcgtgcattccagctcgtgcggtgagcgcacgcacgccgccgctgccgcgttcacacggccccccaaagtcgggggaggggtcgtggagcgaaggagctgtaggcagattttctttctctttccgagctgggaaaagggccagccccgtgccctgcacgcctggctctgctttgcagcttgccggtgagccaagagccggtagagcagaggaggcgcacggttcgggtcgtgtcaccatttcttggcttgctgacctggccaggagctggggatggcggcagcaccgcggaggtacgctttgcgctgccctcacgctcccttccgaaagcagtgcccccagggggaaagttcgcaatgccatttgtctcgccggcaaagttctgggatgtcgggcatcttttgaggagggggaagacgcggcacccttactgaggccggcaggccaggaagagaagttctccgggcgcagggcgcagcccagctccggggaccctctgggcctcccgcgtgccggccgggatgaagcgcgctttgcaccggacccgggattcgggggcgggggctggcgctggcagcgtcagacgctgcttcatttcccctcgaccctggggaggacagcaacaagtcctgccccagccatttcatcaccctgctagcacgtgcagattccgggccctcggagcccggcgcggacctcgccttgcctcgcgcttccctttgcacgtcccgtgccatcccaagagtttgcgtggccctgggtgggcgcctggctcccggcgaaacgcctggggcgcgccgcgtgggtgcacggtgtcctctcccagtagctcccggctgcgggggcacatgcacttacctgtattctgcagggacaggcggcctttctgctgggagctcctgtcttggggaccctcgggtgggttggtggcgtcggtcccccgcgccgggtcaaaggtggccaacaccaaagccagggtcatgaactggcccagccgctcggcacacatggttcttggtattaacctcccgtcgggagacctggatcctttgtgctcccctcttcctcctcctcctcttcctccttcgccgcttcccctcctcctcccactcttcctttttgctcgccttttccctcctcctcgcggccgcggctcggatagaggttacccagcgccctcccgtagctctccggagagcatgtgaccaggccgttagcagcgccgcgagtgcccggcaatggcagggatggtgcctcaaatatccctggaagctctggtgtcacttgaatgaaggagtcgagcaggtgttgtcccggcggctggaccaatccgagaccccggcccttttgacaacacggccgggaggcggggcctgcgctcaactactacaggaggaagccgagcgccgctgggagcgccggacaaagttgccgacctggcggcggccacgcgtttgcgtgcgtgtgtatgagtgt

SEQ ID NO: 125275 - DNA, 845 bp, Homo sapiens; identical to SEQ ID NO: 30122
  misc_feature 1..845: note = chr5:172756377-172757222
  misc_feature 1..845: note = Hyper
  source 1..845: mol_type = genomic DNA

SEQ ID NO: 125276 - DNA, 36 bp, Homo sapiens; identical to SEQ ID NO: 93405
  misc_feature 1..36: note = chr5:172997890-172997926
  misc_feature 1..36: note = Hypo
  source 1..36: mol_type = genomic DNA

SEQ ID NO: 125277 - DNA, 30 bp, Homo sapiens; identical to SEQ ID NO: 93409
  misc_feature 1..30: note = chr5:173165886-173165916
  misc_feature 1..30: note = Hypo
  source 1..30: mol_type = genomic DNA

SEQ ID NO: 125278 - DNA, 30 bp, Homo sapiens; identical to SEQ ID NO: 93411
  misc_feature 1..30: note = chr5:173397062-173397092
  misc_feature 1..30: note = Hypo
  source 1..30: mol_type = genomic DNA

SEQ ID NO: 125279 - DNA, 515 bp, Homo sapiens; identical to SEQ ID NO: 93412
  misc_feature 1..515: note = chr5:173738828-173739343
  misc_feature 1..515: note = Hyper
  source 1..515: mol_type = genomic DNA

SEQ ID NO: 125280 - DNA, 30 bp, Homo sapiens; identical to SEQ ID NO: 93413
  misc_feature 1..30: note = chr5:173846564-173846594
  misc_feature 1..30: note = Hyper
  source 1..30: mol_type = genomic DNA

SEQ ID NO: 125281 - DNA, 39 bp, Homo sapiens; identical to SEQ ID NO: 93414
  misc_feature 1..39: note = chr5:173846846-173846885
  misc_feature 1..39: note = Hyper
  source 1..39: mol_type = genomic DNA

SEQ ID NO: 125282 - DNA, 30 bp, Homo sapiens; identical to SEQ ID NO: 40644
  misc_feature 1..30: note = chr5:174110957-174110987
  misc_feature 1..30: note = Hypo
  source 1..30: mol_type = genomic DNA

SEQ ID NO: 125283 - DNA, 338 bp, Homo sapiens; identical to SEQ ID NO: 93416
  misc_feature 1..338: note = chr5:174115251-174115589
  misc_feature 1..338: note = Hyper
  source 1..338: mol_type = genomic DNA

SEQ ID NO: 125284 - DNA, 30 bp, Homo sapiens; identical to SEQ ID NO: 93417
  misc_feature 1..30: note = chr5:174115938-174115968
  misc_feature 1..30: note = Hyper
  source 1..30: mol_type = genomic DNA

SEQ ID NO: 125285 - DNA, 147 bp, Homo sapiens; identical to SEQ ID NO: 93418
  misc_feature 1..147: note = chr5:174119987-174120134
  misc_feature 1..147: note = Hyper
  source 1..147: mol_type = genomic DNA

SEQ ID NO: 125286 - DNA, 39 bp, Homo sapiens; identical to SEQ ID NO: 93419
  misc_feature 1..39: note = chr5:174120367-174120406
  misc_feature 1..39: note = Hyper
  source 1..39: mol_type = genomic DNA

SEQ ID NO: 125287 - DNA, 794 bp, Homo sapiens; identical to SEQ ID NO: 93420
  misc_feature 1..794: note = chr5:174147420-174148214
  misc_feature 1..794: note = Hyper
  source 1..794: mol_type = genomic DNA

SEQ ID NO: 125288 - DNA, 37 bp, Homo sapiens; identical to SEQ ID NO: 30127
  misc_feature 1..37: note = chr5:174150431-174150468
  misc_feature 1..37: note = Hyper
  source 1..37: mol_type = genomic DNA

SEQ ID NO: 125289 - DNA, 72 bp, Homo sapiens; identical to SEQ ID NO: 30128
  misc_feature 1..72: note = chr5:174151125-174151197
  misc_feature 1..72: note = Hyper
  source 1..72: mol_type = genomic DNA

SEQ ID NO: 125290 - DNA, 326 bp, Homo sapiens; identical to SEQ ID NO: 93423
  misc_feature 1..326: note = chr5:174151443-174151769
  misc_feature 1..326: note = Hyper
  source 1..326: mol_type = genomic DNA

SEQ ID NO: 125291 - DNA, 928 bp, Homo sapiens
  misc_feature 1..928: note = chr5:174158665-174159593
  misc_feature 1..928: note = Hyper
  source 1..928: mol_type = genomic DNA
tcagatgggaggctccggtgactcggaacagaggcagaaaggatgcgaggacttcttgctgcgtaaacagcgcggcgggcagattggcacctggcacctaccaggactggcgcttcgtcccgcgtttccattgtgcccgcacgcactttgaaagtgggcgccggaaactccgtttttcttatggggccggggtcgggcaacgtggttcagaggtttcacaagctccagcacagaagtgatccaaaccgaggggtcggctcgaagtcggaggctgattttgtcttgctcagtcgctccgccggagctgagccgctggaacgacccaaacctacctgaaagcgcgtctctgcagtcccgctggacttctccggctcgaactcctaatctcagcccggaatccagccatattcatttaaggattgcgttttccaaaggccaaagcctttcccggtttcgtcatcagccgccaggttgggtccctaattagcctgtccaccgagcttccttcccggcgccgcttggaccccgcagccccgggcgatctcagcccgggtggggaatccggagacgccggctccgggttaagactctgctcgtccccaggaggacggggtcgcgatccagagtgcgatccggagaaaagggctgcatcttgcgtggctggcgggttagactggaatccgtctggggaactgcgcaccatccccatcgctccagacgccgaaacaaaacctgaggctcggagaggggaaaaagagttgttcaggctcgaacatacgcatcccagcctcataggtggatggggttaccgagctgagaaccaagccggaggtccgcgaagccgggccgcccccttgctctgggcctcccttcaagcctgcagtctggggatgggttccgagtcaccgcggtccgggcctcggtcagg

SEQ ID NO: 125292 - DNA, 30 bp, Homo sapiens; identical to SEQ ID NO: 30131
  misc_feature 1..30: note = chr5:174162217-174162247
  misc_feature 1..30: note = Hyper
  source 1..30: mol_type = genomic DNA

SEQ ID NO: 125293 - DNA, 362 bp, Homo sapiens; identical to SEQ ID NO: 93427
  misc_feature 1..362: note = chr5:174162494-174162856
  misc_feature 1..362: note = Hyper
  source 1..362: mol_type = genomic DNA

SEQ ID NO: 125294 - DNA, 80 bp, Homo sapiens; identical to SEQ ID NO: 93428
  misc_feature 1..80: note = chr5:174178168-174178248
  misc_feature 1..80: note = Hyper
  source 1..80: mol_type = genomic DNA

SEQ ID NO: 125295 - DNA, 283 bp, Homo sapiens; identical to SEQ ID NO: 93429
  misc_feature 1..283: note = chr5:174178631-174178914
  misc_feature 1..283: note = Hyper
  source 1..283: mol_type = genomic DNA

SEQ ID NO: 125296 - DNA, 112 bp, Homo sapiens
  misc_feature 1..112: note = chr5:174220830-174220942
  misc_feature 1..112: note = Hyper
  source 1..112: mol_type = genomic DNA
gggctccagtctgagcgcctcctccgcgacgcgccacatggctggcaccggcgcgcccccgcgcggccgcctgcgagaagctcactctccgcggaggcgaaatctggttttg

SEQ ID NO: 125297 - DNA, 1267 bp, Homo sapiens; identical to SEQ ID NO: 93432
  misc_feature 1..1267: note = chr5:174870699-174871966
  misc_feature 1..1267: note = Hyper
  source 1..1267: mol_type = genomic DNA

SEQ ID NO: 125298 - DNA, 44 bp, Homo sapiens; identical to SEQ ID NO: 93434
  misc_feature 1..44: note = chr5:174921456-174921500
  misc_feature 1..44: note = Hypo
  source 1..44: mol_type = genomic DNA

SEQ ID NO: 125299 - DNA, 950 bp, Homo sapiens
  misc_feature 1..950: note = chr5:175084819-175085769
  misc_feature 1..950: note = Hyper
  source 1..950: mol_type = genomic DNA
ggcaagtgtcagagtcggcgagatgaggagggagggtgtaggagaaaggaaaatagaaagtgggtgagaccgtgggagagggagactgggggagaaaatgtgggcgtgtgcgcgctgagagagagagagagagagagagacttggagagggaaggaagggaaggagcgttgagagcaaggaggagcgagttgggggcggagacgaggaagtgggtgcgaggcgcggggcgcaggccgtgcgcgcgccgcccgctgcatccctgcccggagcgcagccggcgcgggcgcgggaccgaggcgaaccgggtgcggagccaatacccgcggcagcagcaccaggtaacgcggccgccgcctccccgcggggcctcggctcggggtggggtcccaggcgggcttggggacccggcgtgggctggcggagccgcccgaggggctgctcgggatccccggcggccgtcgtggccccgaacccgggttcgagcctcggccccaccgctccctggctgtgcctgaccttgggcaggtgcctccgcctggcctgcgagcctcagtttccttgtctgtgaccgcgggggtcgtgccttccccaagggggcgttgagagctcgggatgcagccccggtgcacagcagtgctcgggacgcgggtcggctttatatcccctttgcccgcgaagggtggatttggaaagtgcacttgcgccgaaacagtccccgttttgtctccgggtctgggtggtggcattttctcgcggcgatgtgtctgtcggagcatggagcaactttctgctaaagggaagccagcggagagcgggggctgctggggaggaggcttctatgtctcaggaaaccagaacgacctgccttcatcccgctgggctgccgcccgctgccggatgaccgatgaccggagccacaacaggcagcgctcagcgggtgggagtcctt

SEQ ID NO: 125300 - DNA, 30 bp, Homo sapiens; identical to SEQ ID NO: 40645
  misc_feature 1..30: note = chr5:175115079-175115109
  misc_feature 1..30: note = Hypo
  source 1..30: mol_type = genomic DNA

SEQ ID NO: 125301 - DNA, 1492 bp, Homo sapiens
  misc_feature 1..1492: note = chr5:175223481-175224973
  misc_feature 1..1492: note = Hyper
  source 1..1492: mol_type = genomic DNA
tgccacctctgctggcgtcctctctcatctccgccgccagcccccgcctcctttctcgggaagcttgggtctccctgggagcgggtctgcccttagggggaggcctctgggctctgtgccctgcagctcggcaggcattcgaggcggacagaaacggggcttggcgccccccgcgtgcacgtgtgctagcccaggcaggagggagcgcctcggcggaggagtcaaggaagagggggagggagaaacgcgccagaacctcggcccgggcgccctcgtcggccgcggaggagctgcagcctccaacaggttcgtagaacgcgcgctcgctccctgtggctgagccgccctcctccgcgggagcggttggcggagagaccccggccacaggccccgcgctcgagagcttcctagaggcggcttcctccggcctctccccctccctggagctctcagccgccggcggctcttccggggcgaggcagagggcgcctcgggcttctcgctccagcaccatctcggggacagctcccgcgccgcaccgggtccctatcgggtcagcactgcagcggcggacagcggcggccgggcgggctcctccgcaccctccgccctggttccgcgcggctgctaaggaccgtccctcgcccccgcgggccgctcccaacgctagcaccgcggcggcggacagctctctccggcggcaccgcgaaccgcgaacaaagccgcgggtctggggcccccagcgcgcctaggggtggcgtgaggccgcatcgatcgggggatttcagcttctcccagagaggtgtcaccggcgagctaggcgggggcctagcacagccgcgcgtctccggcttgggtccgccgcccgccgaggcctggccgtgcaatggcggggcccagctaagagtgggcaagaggtagaggggaaacaggcacagaacggtcccggctccgctaggcgggctgggcctaggctgaggtcccggcggggaggaaggagtgcgccgccccgtcttccctccagacccccaccccatcccagctcagaatcgcggacttccaagagccctgcacagaagcccgcggctggcagctgcaatcactgactccggctgtccccggaacatccctagaaagtgtgaggctgagtttccgtagggggagggggctgagaagccgcggggaagcctcacgaacgggacagctccaggctccctctctccctcactccccgggttccgcccccacctccagagaaatcccagacggcagagaaggcaggggggagggggcgacccagacagcaggttgcgaactcggcttagacctgggaggttgcaattagcaagaaaaaaggttgagggcgtctgtgaagccgggaggttcccaaacagggaagccagttccgcggcaggaaagcatacgtggaagagaaaccttttctctgagagctgaggctgggagggccctcggatcacgtgacactctagat

SEQ ID NO: 125302 - DNA, 1912 bp, Homo sapiens
  misc_feature 1..1912: note = chr5:175298500-175300412
  misc_feature 1..1912: note = Hyper
  source 1..1912: mol_type = genomic DNA
catctggaaggggagcggtagaacgtcagggcccggctgaggggcgtgattggagggcgccttcggcagccgcccgcggcagaagccgcggctccagctcgcctggcggaattgcacgcggcggcgggagctggaatagcagaaggaaccacctcgtggagtcgggccggagccctgcagtggctcagacggttgcagggaccgccaggtcggtgctggccgagggccgggagggcggagctgggctgtgggcaacagggtcccggctctcgcctcgaggccttggggcagctcgggaagctggggagcacggctttcggggggacagctccccaaggctgcctgggcaccggatggggactgagaggcggtaaaggggacactcccgggtgcgctctccgtggtgctgaaaggacagctccttgcgaggggccgcgagcaggcagctagctgcgaactaagaggaagcgtgggccctagccggagactccgggcagagcccgaacggccggggtcccggagccaggaccgccccggctgcggcggagactcaagtctgaacccagagaacaactttgagctcgcgggagtgggggacgtcgatctaagctacttctggctgtgcttaacccgaagcccgccggagcacgcttcgccccggaggagggagtcgcccccaggggtacagtgcgcactcccggagtgagtcagagggcggcggcaggggggcggacagaccgcaggtggaggggaggagaacgtagacattgacaggggatgggggaccaaggggactatttgtccctttccgggaggagccgccgcttggacagcgcacgcccgccgcctggagtcttcgggaacgaccccttctgtgctctcgttctcgtcggcctcaatctgcccccttccccagcaaagtttgaaaccgggccgggtcttggggttggagctatgtgtgttgggggaaggggcgctctccgtggcccaccgggagatccaggacagagctgctgggggtgtgggtctccgcgggggtccgggagaggggcgccggggttcctgtcctctcttctggccgggaaacgggaacccccggccacttccgcttttcagccggagtcggctccctacctcctcccatcctccgctgcccctcccctcccccatgcgtctcccatcccgggccacggggtggggacggggcggggggagggggtggagtgacatcccctgtctctgccactgcctttggcgtagtcccctgccagaagcaaatgagtgttgaattgagttgcggtgaatatagcccagacttgaatcataaaaacagaaaaacggccataaggacaaccactgcaggttacccgagtcagcctgtcagatggcggggcccagtcccgaaaacctctaggggctcagatggtcgagcctgagtcggtgcttgggctgggacgggctcggagggagtcggagaggggaaggaagctgaaggcgcgccctgggtccccggcgcactgaaggtacggaaacctggtgctacgacggcatccctcgccgcccccggcctcccctcccccagcgcagcatcccccacccacccccactcccacccacccccaccctcaccccccttcccgcgcagggatagaccaaggcttcccgcagaatcgctaaggagcgcctcctggcggcctggcccaaatcctcaactgccggcaacctgctggacctcagcactcccgcaggcatatggcaaaacatacacacacacacaccctgcacacacgcacgcactcacacgatgtctaagtccagagttgcacacacggggtcatactttcaacgcacacaccctcatgcactcgttgacacgttaaattcaacccggcacacacgtcctcaggatcta

SEQ ID NO: 125303 - DNA, 151 bp, Homo sapiens; identical to SEQ ID NO: 93448
  misc_feature 1..151: note = chr5:175488087-175488238
  misc_feature 1..151: note = Hyper
  source 1..151: mol_type = genomic DNA

SEQ ID NO: 125304 - DNA, 308 bp, Homo sapiens; identical to SEQ ID NO: 30150
  misc_feature 1..308: note = chr5:175560514-175560822
  misc_feature 1..308: note = Hyper
  source 1..308: mol_type = genomic DNA

SEQ ID NO: 125305 - DNA, 136 bp, Homo sapiens; identical to SEQ ID NO: 40646
  misc_feature 1..136: note = chr5:175605006-175605142
  misc_feature 1..136: note = Hypo
  source 1..136: mol_type = genomic DNA

SEQ ID NO: 125306 - DNA, 30 bp, Homo sapiens; identical to SEQ ID NO: 14798
  misc_feature 1..30: note = chr5:175610717-175610747
  misc_feature 1..30: note = Hypo
  source 1..30: mol_type = genomic DNA

SEQ ID NO: 125307 - DNA, 230 bp, Homo sapiens; identical to SEQ ID NO: 93452
  misc_feature 1..230: note = chr5:175621329-175621559
  misc_feature 1..230: note = Hyper
  source 1..230: mol_type = genomic DNA

SEQ ID NO: 125308 - DNA, 175 bp, Homo sapiens; identical to SEQ ID NO: 93453
  misc_feature 1..175: note = chr5:175626544-175626719
  misc_feature 1..175: note = Hyper
  source 1..175: mol_type = genomic DNA

SEQ ID NO: 125309 - DNA, 1058 bp, Homo sapiens
  misc_feature 1..1058: note = chr5:175792160-175793218
  misc_feature 1..1058: note = Hyper
  source 1..1058: mol_type = genomic DNA
caaagcactacgatgcggcgttgggcgggttacttaactcctgggcctcggttttcccttctgcgtggtatcattgtaaggggtaacggagaaaagccgtgagctaacccctggtggatgctagcaagcaccgccgtctcccgtcctccccaggcacagcctctccttcctccaccctgcacctggcagggggaccggaggtccccgcgcgccggccagcgccccaccacccacgccgccgggtcccgggcggcctgccgtgacagcggcagtgcattgtggggcttgtagtgcgggactgggtctgggtgggtgggcgcggccgcagcagtcgcagcggggccatcttcggcgggcgagtgggctcggcctgtgcaacccgcacctgcgtccctcgcccggcccgatggcgccgcggccgctgggccccttggtgctggcgctgggcggcgccgcggcggtgctgggctcggtgctcttcatcctctggaagacctacttcggccgcggccgagagcggcgctgggaccggggagaggcctggtggggcgcggaggctgcccgcctccccgagtgggacgagtgggacgtgagtgccgggccgaggcctgcggaagggcgggcaggctgggctgcgactccgcgcatgtggccaaggggtgtgaccacggaacggccctgctggtgccgggagcttggggggtcgagggcttggcagccgcagcgcacaggccccgcgcgggtgggcggtcagagcccgggaaccgaggaacgggtgggtgtgcttgggtgcgtgcggcgccttggcgccacgccgtcgctccacgccatgaggctcgggtgttccagcgggggccggagtttggagggcgcggctcgggagcatcccggggcccagccgggtcggctcgcgcccctccggcgcctgcgcagtgcaccccgcccgggggtggggatgtcgggagaaaccccatcccctcccgcctgcggtcgggactccgagaccggtggaggaagcggggcgcgcgagcgtttaaggaattcgccaagggtttgga

SEQ ID NO: 125310 - DNA, 30 bp, Homo sapiens; identical to SEQ ID NO: 93456
  misc_feature 1..30: note = chr5:175832567-175832597
  misc_feature 1..30: note = Hypo
  source 1..30: mol_type = genomic DNA

SEQ ID NO: 125311 - DNA, 30 bp, Homo sapiens; identical to SEQ ID NO: 93457
  misc_feature 1..30: note = chr5:175844227-175844257
  misc_feature 1..30: note = Hypo
  source 1..30: mol_type = genomic DNA

SEQ ID NO: 125312 - DNA, 17 bp, Homo sapiens
  misc_feature 1..17: note = chr5:175876289-175876306
  misc_feature 1..17: note = Hypo
  source 1..17: mol_type = genomic DNA
cccccaggccaggagcg

SEQ ID NO: 125313 - DNA, 17 bp, Homo sapiens
  misc_feature 1..17: note = chr5:175876606-175876623
  misc_feature 1..17: note = Hypo
  source 1..17: mol_type = genomic DNA
ttcgggagatcaaatgg

SEQ ID NO: 125314 - DNA, 19 bp, Homo sapiens
  misc_feature 1..19: note = chr5:175879322-175879341
  misc_feature 1..19: note = Hypo
  source 1..19: mol_type = genomic DNA
tgctcggattacaggcgtg

SEQ ID NO: 125315 - DNA, 30 bp, Homo sapiens; identical to SEQ ID NO: 14801
  misc_feature 1..30: note = chr5:175924856-175924886
  misc_feature 1..30: note = Hypo
  source 1..30: mol_type = genomic DNA

SEQ ID NO: 125316 - DNA, 151 bp, Homo sapiens; identical to SEQ ID NO: 93462
  misc_feature 1..151: note = chr5:175971719-175971870
  misc_feature 1..151: note = Hypo
  source 1..151: mol_type = genomic DNA

SEQ ID NO: 125317 - DNA, 185 bp, Homo sapiens; identical to SEQ ID NO: 93463
  misc_feature 1..185: note = chr5:175972891-175973076
  misc_feature 1..185: note = Hypo
  source 1..185: mol_type = genomic DNA

SEQ ID NO: 125318 - DNA, 30 bp, Homo sapiens; identical to SEQ ID NO: 14803
  misc_feature 1..30: note = chr5:175975036-175975066
  misc_feature 1..30: note = Hypo
  source 1..30: mol_type = genomic DNA

SEQ ID NO: 125319 - DNA, 34 bp, Homo sapiens; identical to SEQ ID NO: 93465
  misc_feature 1..34: note = chr5:175978986-175979020
  misc_feature 1..34: note = Hypo
  source 1..34: mol_type = genomic DNA

SEQ ID NO: 125320 - DNA, 393 bp, Homo sapiens
  misc_feature 1..393: note = chr5:176023853-176024246
  misc_feature 1..393: note = Hyper
  source 1..393: mol_type = genomic DNA
cacactctgcagcagcgcgcggaacaggccgggcggacgcttggcggcgccatctgggggcgcggtgcgcaccgagcccgaacggccggggccggcacgggcggcgggcggcggcgcgggcgccccttggcggccgtgctcctcgatctgtcgctccagatgcttctggatggccatgcccagcacctccacctccatggcggcgccgtatacctcccacgtcatgcccttctcgtcccagctcacgtctcgcacgggctcagccggctccgggggcgctacagcggccgccagcgctgagccgggccgcacccgcacttcggggaaggcgggcggcgcggcggcttgaggtgtcatgggcccagtggccacggagcgcgtctcggcggcgcc

SEQ ID NO: 125321 - DNA, 108 bp, Homo sapiens; identical to SEQ ID NO: 93468
  misc_feature 1..108: note = chr5:176038513-176038621
  misc_feature 1..108: note = Hyper
  source 1..108: mol_type = genomic DNA

SEQ ID NO: 125322 - DNA, 324 bp, Homo sapiens; identical to SEQ ID NO: 93469
  misc_feature 1..324: note = chr5:176046278-176046602
  misc_feature 1..324: note = Hyper
  source 1..324: mol_type = genomic DNA

SEQ ID NO: 125323 - DNA, 659 bp, Homo sapiens; identical to SEQ ID NO: 30159
  misc_feature 1..659: note = chr5:176056505-176057164
  misc_feature 1..659: note = Hyper
  source 1..659: mol_type = genomic DNA

SEQ ID NO: 125324 - DNA, 454 bp, Homo sapiens; identical to SEQ ID NO: 93471
  misc_feature 1..454: note = chr5:176057373-176057827
  misc_feature 1..454: note = Hyper
  source 1..454: mol_type = genomic DNA

SEQ ID NO: 125325 - DNA, 533 bp, Homo sapiens
  misc_feature 1..533: note = chr5:176107053-176107586
  misc_feature 1..533: note = Hyper
  source 1..533: mol_type = genomic DNA
tgcaggctgcagtgccgctctgctccggccttagcgcctccccgcagctcagaggatgggactggggtccagctccctgcccgccccgcaccccgtaccccgcagcctgtccgtccatccgccccgcttcacttcgctgtcccctgtcggggttcgagtcgcagcctccagcctcaacccgcacctcccgccctgcagctcaactctcgcctccgctgcaatttattactggaggccgcagaaccagcggcgtggagtgcgcctcccgggagccgccgctgtcggagaaaggcacccacccgcctgggccggctcccgggcgcggggcggtgtctcagggaggcgtctcagccgagctgcagggcgaggggagcgagccgggtcccgggggaaggcatccggtcagggcctcgcccacccggatggctcctgcgccacggggcctgagctccgcctttgggatccgcgaggattggagactggggacccggcagcagagggtccaggcagaaaagctccgtgtggcccccagg

SEQ ID NO: 125326 - DNA, 313 bp, Homo sapiens
  misc_feature 1..313: note = chr5:176170309-176170622
  misc_feature 1..313: note = Hyper
  source 1..313: mol_type = genomic DNA
ccgggggtgcgggtgcgccgagccctcgggaggcctggctctggtgtgggctgcggggagaaggcgcgggaaggaaggaaggaggcgaagcggtgcgggagggaggcggccgttgccatggaaggagctgcaaggtactctgggaccagaattctctctgcagagggtcgggtggggggcggccggctggggaaggtgaggggaaatccagtgccattcctttgtccttggcgcttctcagcctccctgcagaccgcgagcggagcccccgcacccccggggctggcccctggcctcccgccccagcccggcc

SEQ ID NO: 125327 - DNA, 30 bp, Homo sapiens; identical to SEQ ID NO: 93475
  misc_feature 1..30: note = chr5:176170885-176170915
  misc_feature 1..30: note = Hyper
  source 1..30: mol_type = genomic DNA

SEQ ID NO: 125328 - DNA, 160 bp, Homo sapiens; identical to SEQ ID NO: 93476
  misc_feature 1..160: note = chr5:176225826-176225986
  misc_feature 1..160: note = Hypo
  source 1..160: mol_type = genomic DNA

SEQ ID NO: 125329 - DNA, 828 bp, Homo sapiens
  misc_feature 1..828: note = chr5:176236431-176237259
  misc_feature 1..828: note = Hyper
  source 1..828: mol_type = genomic DNA
aggcgtttgagtttgcgaccctgccctcaccctgctcattcccctcccgacccagactaggaccctctctttttccgatcactccccccaggcacaccgcacgcggctgtcatttcctttctccttcaaggcagccctctgtttattttaacccgattagggaatgggggtggggcacaggagactccagcagcggtcactgctggaggctccaggagacgacgtgacttgaccaaggtcacagagctggaaggtgaagtcgcctggaccctacccccggtctccctagctgccaaagcccagctcgttcctttacacccacgtcgcgggcgccgtgcgctctcggggctcaaacaccgcgcgcccagtcgggtgtgctgcgcctgaaggttgttttccttcggcgaacggcgccgaggggttagggaaaccttgggtcatggtgtgaggcgcgcccctggaatccaccagcctgcgaggctgggactgcgggtgtccccgagtctggcctgccagctctggtggccagggcacctctgcgcgcgggccagggccccggggctctcccgcagtcccctaaccaagccgcgggctggcagcgtaccgcggcgcccggacgaccccggagcgcggccgcgaggaaagggcgggggagaggactgcagcggaacctgcccggggcacccctgccctgggcggctctccgcaggctggcgccgcgccggggtcgccgcagccccgggcccctcccgggccacctgtgcgcagactggcgggcccgcgagagcccggatccggagcaccgatccactccgggtttcagactcc

SEQ ID NO: 125330 - DNA, 144 bp, Homo sapiens; identical to SEQ ID NO: 93479
  misc_feature 1..144: note = chr5:176237750-176237894
  misc_feature 1..144: note = Hyper
  source 1..144: mol_type = genomic DNA

SEQ ID NO: 125331 - DNA, 30 bp, Homo sapiens; identical to SEQ ID NO: 93480
  misc_feature 1..30: note = chr5:176244317-176244347
  misc_feature 1..30: note = Hyper
  source 1..30: mol_type = genomic DNA

SEQ ID NO: 125332 - DNA, 83 bp, Homo sapiens; identical to SEQ ID NO: 93481
  misc_feature 1..83: note = chr5:176244689-176244772
  misc_feature 1..83: note = Hyper
  source 1..83: mol_type = genomic DNA

SEQ ID NO: 125333 - DNA, 103 bp, Homo sapiens; identical to SEQ ID NO: 93482
  misc_feature 1..103: note = chr5:176249208-176249311
  misc_feature 1..103: note = Hypo
  source 1..103: mol_type = genomic DNA

SEQ ID NO: 125334 - DNA, 105 bp, Homo sapiens; identical to SEQ ID NO: 93483
  misc_feature 1..105: note = chr5:176264795-176264900
  misc_feature 1..105: note = Hyper
  source 1..105: mol_type = genomic DNA

SEQ ID NO: 125335 - DNA, 45 bp, Homo sapiens; identical to SEQ ID NO: 93484
  misc_feature 1..45: note = chr5:176289688-176289733
  misc_feature 1..45: note = Hypo
  source 1..45: mol_type = genomic DNA

SEQ ID NO: 125336 - DNA, 74 bp, Homo sapiens; identical to SEQ ID NO: 93485
  misc_feature 1..74: note = chr5:176295173-176295247
  misc_feature 1..74: note = Hypo
  source 1..74: mol_type = genomic DNA

SEQ ID NO: 125337 - DNA, 60 bp, Homo sapiens; identical to SEQ ID NO: 93486
  misc_feature 1..60: note = chr5:176296603-176296663
  misc_feature 1..60: note = Hypo
  source 1..60: mol_type = genomic DNA

SEQ ID NO: 125338 - DNA, 264 bp, Homo sapiens; identical to SEQ ID NO: 93487
  misc_feature 1..264: note = chr5:176315296-176315560
  misc_feature 1..264: note = Hypo
  source 1..264: mol_type = genomic DNA

SEQ ID NO: 125339 - DNA, 30 bp, Homo sapiens; identical to SEQ ID NO: 93488
  misc_feature 1..30: note = chr5:176473003-176473033
  misc_feature 1..30: note = Hypo
  source 1..30: mol_type = genomic DNA

SEQ ID NO: 125340 - DNA, 57 bp, Homo sapiens; identical to SEQ ID NO: 93490
  misc_feature 1..57: note = chr5:176558851-176558908
  misc_feature 1..57: note = Hypo
  source 1..57: mol_type = genomic DNA

SEQ ID NO: 125341 - DNA, 69 bp, Homo sapiens; identical to SEQ ID NO: 93491
  misc_feature 1..69: note = chr5:176560249-176560318
  misc_feature 1..69: note = Hyper
  source 1..69: mol_type = genomic DNA

SEQ ID NO: 125342 - DNA, 138 bp, Homo sapiens; identical to SEQ ID NO: 93492
  misc_feature 1..138: note = chr5:176764100-176764238
  misc_feature 1..138: note = Hypo
  source 1..138: mol_type = genomic DNA

SEQ ID NO: 125343 - DNA, 163 bp, Homo sapiens; identical to SEQ ID NO: 40661
  misc_feature 1..163: note = chr5:176795125-176795288
  misc_feature 1..163: note = Hypo
  source 1..163: mol_type = genomic DNA

SEQ ID NO: 125344 - DNA, 78 bp, Homo sapiens; identical to SEQ ID NO: 93494
  misc_feature 1..78: note = chr5:176864849-176864927
  misc_feature 1..78: note = Hypo
  source 1..78: mol_type = genomic DNA

SEQ ID NO: 125345 - DNA, 52 bp, Homo sapiens; identical to SEQ ID NO: 93495
  misc_feature 1..52: note = chr5:176884410-176884462
  misc_feature 1..52: note = Hypo
  source 1..52: mol_type = genomic DNA

SEQ ID NO: 125346 - DNA, 70 bp, Homo sapiens; identical to SEQ ID NO: 93496
  misc_feature 1..70: note = chr5:176911102-176911172
  misc_feature 1..70: note = Hypo
  source 1..70: mol_type = genomic DNA

SEQ ID NO: 125347 - DNA, 154 bp, Homo sapiens; identical to SEQ ID NO: 93497
  misc_feature 1..154: note = chr5:177003236-177003390
  misc_feature 1..154: note = Hypo
  source 1..154: mol_type = genomic DNA

SEQ ID NO: 125348 - DNA, 94 bp, Homo sapiens; identical to SEQ ID NO: 93498
  misc_feature 1..94: note = chr5:177019952-177020046
  misc_feature 1..94: note = Hypo
  source 1..94: mol_type = genomic DNA

SEQ ID NO: 125349 - DNA, 30 bp, Homo sapiens; identical to SEQ ID NO: 93499
  misc_feature 1..30: note = chr5:177024976-177025006
  misc_feature 1..30: note = Hypo
  source 1..30: mol_type = genomic DNA

SEQ ID NO: 125350 - DNA, 462 bp, Homo sapiens; identical to SEQ ID NO: 93500
  misc_feature 1..462: note = chr5:177031103-177031565
  misc_feature 1..462: note = Hypo
  source 1..462: mol_type = genomic DNA

SEQ ID NO: 125351 - DNA, 30 bp, Homo sapiens; identical to SEQ ID NO: 93501
  misc_feature 1..30: note = chr5:177374034-177374064
  misc_feature 1..30: note = Hypo
  source 1..30: mol_type = genomic DNA

SEQ ID NO: 125352 - DNA, 30 bp, Homo sapiens; identical to SEQ ID NO: 93502
  misc_feature 1..30: note = chr5:177385531-177385561
  misc_feature 1..30: note = Hypo
  source 1..30: mol_type = genomic DNA

SEQ ID NO: 125353 - DNA, 149 bp, Homo sapiens; identical to SEQ ID NO: 93503
  misc_feature 1..149: note = chr5:177387547-177387696
  misc_feature 1..149: note = Hypo
  source 1..149: mol_type = genomic DNA

SEQ ID NO: 125354 - DNA, 30 bp, Homo sapiens; identical to SEQ ID NO: 93504
  misc_feature 1..30: note = chr5:177408490-177408520
  misc_feature 1..30: note = Hypo
  source 1..30: mol_type = genomic DNA

SEQ ID NO: 125355 - DNA, 883 bp, Homo sapiens
  misc_feature 1..883: note = chr5:177411327-177412210
  misc_feature 1..883: note = Hyper
  source 1..883: mol_type = genomic DNA
actcttgtggagacccggacgtcaggcgtggcgcgttggggaagcagctccacggggacccaggaggcgccggccgggttgagccgggttggttccgacccaagagagctcgtcccacgacggagcaggtccctttgcatcccgcggggccgccaggtgcaattttcgctgggccgacggcgcggagatgggccagagtccggccatccagaagtgcctggagcgcacagcaaggccctgccctcggctccgtgaaggtgagggggtaaagtcggcccggagtccccgggggtgcaggaggggccccgcgggttccagcagaccctcgacggaacgttccaggcaggcgagatctcgcacagaatctgcccttttaaaggctcggctttgtcctcgttaaacttgcgtctggcaacgcgaccgctgcggctcccgagcaagattagagggtttccgctcgcaggggcgcgcccggggaccgcgcctccccgcctggtctcggcgccccggcccaggggtcttcagtggtgaggggcgcccagatcgctgcatcccctggagctctgcgcccggccgagccactcagagctcccgccccgcacacccacttcgagctccaagtccttccttttctatactccaagttggatcctgctgggaaggaagggcccttcctgagagaccagggattgcgatttcccagcacaaagtcgaattcatgacttcagcttcaacggggctgcattctccccttggcaggaatgggatggagcgagggtgaagctgctggaaagacactcgttttatttttttaatcgtaaacggggcaacttccaactctgccagttttaagcttctagagtatctcctcggcggagcgcgg

SEQ ID NO: 125356 - DNA, 222 bp, Homo sapiens; identical to SEQ ID NO: 93507
  misc_feature 1..222: note = chr5:177412450-177412672
  misc_feature 1..222: note = Hyper
  source 1..222: mol_type = genomic DNA

SEQ ID NO: 125357 - DNA, 25 bp, Homo sapiens
  misc_feature 1..25: note = chr5:177513856-177513881
  misc_feature 1..25: note = Hypo
  source 1..25: mol_type = genomic DNA
tatttttttttgagacggagtctgt

SEQ ID NO: 125358 - DNA, 30 bp, Homo sapiens; identical to SEQ ID NO: 93509
  misc_feature 1..30: note = chr5:177541524-177541554
  misc_feature 1..30: note = Hyper
  source 1..30: mol_type = genomic DNA

SEQ ID NO: 125359 - DNA, 22 bp, Homo sapiens
  misc_feature 1..22: note = chr5:177571459-177571481
  misc_feature 1..22: note = Hypo
  source 1..22: mol_type = genomic DNA
aaaaaaggccaggcacggtggc

SEQ ID NO: 125360 - DNA, 28 bp, Homo sapiens
  misc_feature 1..28: note = chr5:177580093-177580121
  misc_feature 1..28: note = Hypo
  source 1..28: mol_type = genomic DNA
acaaaaacgttaacgttcagttccttaa

SEQ ID NO: 125361 - DNA, 116 bp, Homo sapiens; identical to SEQ ID NO: 93512
  misc_feature 1..116: note = chr5:177581743-177581859
  misc_feature 1..116: note = Hypo
  source 1..116: mol_type = genomic DNA

SEQ ID NO: 125362 - DNA, 198 bp, Homo sapiens; identical to SEQ ID NO: 93513
  misc_feature 1..198: note = chr5:177589638-177589836
  misc_feature 1..198: note = Hypo
  source 1..198: mol_type = genomic DNA

SEQ ID NO: 125363 - DNA, 36 bp, Homo sapiens; identical to SEQ ID NO: 93514
  misc_feature 1..36: note = chr5:177593271-177593307
  misc_feature 1..36: note = Hypo
  source 1..36: mol_type = genomic DNA

SEQ ID NO: 125364 - DNA, 30 bp, Homo sapiens; identical to SEQ ID NO: 30171
  misc_feature 1..30: note = chr5:177666777-177666807
  misc_feature 1..30: note = Hyper
  source 1..30: mol_type = genomic DNA

SEQ ID NO: 125365 - DNA, 30 bp, Homo sapiens; identical to SEQ ID NO: 40665
  misc_feature 1..30: note = chr5:177673744-177673774
  misc_feature 1..30: note = Hypo
  source 1..30: mol_type = genomic DNA

SEQ ID NO: 125366 - DNA, 21 bp, Homo sapiens
  misc_feature 1..21: note = chr5:177680874-177680895
  misc_feature 1..21: note = Hypo
  source 1..21: mol_type = genomic DNA
ccatctctggctgggcgtggt

SEQ ID NO: 125367 - DNA, 196 bp, Homo sapiens; identical to SEQ ID NO: 93518
  misc_feature 1..196: note = chr5:177713344-177713540
  misc_feature 1..196: note = Hypo
  source 1..196: mol_type = genomic DNA

SEQ ID NO: 125368 - DNA, 30 bp, Homo sapiens; identical to SEQ ID NO: 93519
  misc_feature 1..30: note = chr5:177713980-177714010
  misc_feature 1..30: note = Hypo
  source 1..30: mol_type = genomic DNA

SEQ ID NO: 125369 - DNA, 96 bp, Homo sapiens; identical to SEQ ID NO: 93520
  misc_feature 1..96: note = chr5:177723606-177723702
  misc_feature 1..96: note = Hypo
  source 1..96: mol_type = genomic DNA

SEQ ID NO: 125370 - DNA, 30 bp, Homo sapiens; identical to SEQ ID NO: 93521
  misc_feature 1..30: note = chr5:177750053-177750083
  misc_feature 1..30: note = Hypo
  source 1..30: mol_type = genomic DNA

SEQ ID NO: 125371 - DNA, 29 bp, Homo sapiens
  misc_feature 1..29: note = chr5:177753998-177754027
  misc_feature 1..29: note = Hypo
  source 1..29: mol_type = genomic DNA
gtgagccactgcaccgggccaaaaatgac

SEQ ID NO: 125372 - DNA, 30 bp, Homo sapiens; identical to SEQ ID NO: 93523
  misc_feature 1..30: note = chr5:177767895-177767925
  misc_feature 1..30: note = Hypo
  source 1..30: mol_type = genomic DNA

SEQ ID NO: 125373 - DNA, 34 bp, Homo sapiens; identical to SEQ ID NO: 93524
  misc_feature 1..34: note = chr5:177807711-177807745
  misc_feature 1..34: note = Hypo
  source 1..34: mol_type = genomic DNA

SEQ ID NO: 125374 - DNA, 48 bp, Homo sapiens; identical to SEQ ID NO: 93525
  misc_feature 1..48: note = chr5:177827431-177827479
  misc_feature 1..48: note = Hypo
  source 1..48: mol_type = genomic DNA

SEQ ID NO: 125375 - DNA, 22 bp, Homo sapiens
  misc_feature 1..22: note = chr5:177829100-177829122
  misc_feature 1..22: note = Hypo
  source 1..22: mol_type = genomic DNA
gccaccgcgcccagctgccttt

SEQ ID NO: 125376 - DNA, 40 bp, Homo sapiens; identical to SEQ ID NO: 93527
  misc_feature 1..40: note = chr5:177850350-177850390
  misc_feature 1..40: note = Hypo
  source 1..40: mol_type = genomic DNA

SEQ ID NO: 125377 - DNA, 181 bp, Homo sapiens; identical to SEQ ID NO: 40667
  misc_feature 1..181: note = chr5:177851456-177851637
  misc_feature 1..181: note = Hypo
  source 1..181: mol_type = genomic DNA

SEQ ID NO: 125378 - DNA, 30 bp, Homo sapiens; identical to SEQ ID NO: 93529
  misc_feature 1..30: note = chr5:177868563-177868593
  misc_feature 1..30: note = Hypo
  source 1..30: mol_type = genomic DNA

SEQ ID NO: 125379 - DNA, 30 bp, Homo sapiens; identical to SEQ ID NO: 93530
  misc_feature 1..30: note = chr5:177882733-177882763
  misc_feature 1..30: note = Hypo
  source 1..30: mol_type = genomic DNA

SEQ ID NO: 125380 - DNA, 344 bp, Homo sapiens; identical to SEQ ID NO: 93531
  misc_feature 1..344: note = chr5:177890891-177891235
  misc_feature 1..344: note = Hypo
  source 1..344: mol_type = genomic DNA

SEQ ID NO: 125381 - DNA, 30 bp, Homo sapiens; identical to SEQ ID NO: 14810
  misc_feature 1..30: note = chr5:177982679-177982709
  misc_feature 1..30: note = Hypo
  source 1..30: mol_type = genomic DNA

SEQ ID NO: 125382 - DNA, 166 bp, Homo sapiens; identical to SEQ ID NO: 93534
  misc_feature 1..166: note = chr5:177984059-177984225
  misc_feature 1..166: note = Hypo
  source 1..166: mol_type = genomic DNA

SEQ ID NO: 125383 - DNA, 239 bp, Homo sapiens
  misc_feature 1..239: note = chr5:178003647-178003886
  misc_feature 1..239: note = Hyper
  source 1..239: mol_type = genomic DNA
ggtcgtggagggccccgggctgttcctgatcctcgaactctctcctccccacggccgcggtctcctccccgggccccgcgcgccaggccctgcgaaaagccccaacgggtcccccggcgaccgccgcgccggcctctcggtcctgtcctccgaggcgccaggcctccgcctccagcgcgggcctctcgggcagcgccgcccctccccctgcgcgcacgggaggccgcctgggttcggct

SEQ ID NO: 125384 - DNA, 279 bp, Homo sapiens
  misc_feature 1..279: note = chr5:178004095-178004374
  misc_feature 1..279: note = Hyper
  source 1..279: mol_type = genomic DNA
tgtgggccgaggccccggcgctcctcgctcagcccaactcccaaggcccagcgggtccctgctctgccgtccggggatcccgcgggtggtccggagcccggggcgcggcgcgccgttcattcccgcgtcctggcggggcctgcttcttcccgagccctctccctgcggctggtggtcccagcgtgctggccgcgtctcccctcttctcgggacaccagccctgttggatcagggcccccccacaacgacctgtgccacctcatccgcctctttaaagac

SEQ ID NO: 125385 - DNA, 1348 bp, Homo sapiens
  misc_feature 1..1348: note = chr5:178016588-178017936
  misc_feature 1..1348: note = Hyper
  source 1..1348: mol_type = genomic DNA
tccgagcgcacaccccgtggagactgaccctaggtctgttactccaaagtccctggtctctccttcccctttctcgcggccgcctgcctggcacgggaccctgaggccggagcggagaccgcaaaaccccttggggccggcaccccctgcctccgccttggcgcagacgtgcccatctctgggacggccccgagcgcacgcagccggcgggcgaccctcctcccagagacctgcacgctgcccccggctcccagcgtaccgccaccctcaacccgacacacccaagtccgccccagccacgcgccaagacgctcacctcccgcagcaggcgctccaggtgcggctcggcccaggcgtccagggcgcctggcggccccgcgcgccgcagcagctcccgctcctcctcgagcgccgccacccggccctgcagcgcggccgcctggacacccagcagcaggcaggcagccgccgagcccacggagagcagcaggcacagcgcgctcaccgcccgggacccggccgtcgtcgccgagcgccctccgccgccgccgcccgccgcattgcccttccccgcgtcgccgccgccaccggcgcgctcgcctgggcccatggcgcgttcgtcgcgcgtggactctccgagggggcggtgctgctggggcagaggctgggtgcgagaggagcaggcgggacagcccgaggcacgaggtccgccgggcgcgggggttagcctccgggtagcagcggatcgccgcgcacgcccccttcgccgcagccagctcctccacagcggccactttgggcagtttcctctatgcaaatagaccctgccagaaaaggagcagggacccacccaggggaggagcggccgggctggccccgcgcggcgagggggcgggggcgaggaaggagcgagctcctcggagccacccgtcggcgccgggctgatcccacgcgcagcgcgcacctctgccctcacctagcccgggcgccggcacccgcccccgcacgcacctctgaggcttccccagcccaagcccgcactgtggaccccagaggtcggaggggagcccggcgacaccgcgccccttctgcagcccacccctggctggagcacccaccactcgtgccttagcacattcctctaaacttgtgaattacctttctgacacttgtaaaagttcaaaacttcaaatcctgcaaaaaactgagtgggtctgtcctcggtggtggattagcgccgcttcgtggcggaaagcgacctctgcgcactcacatttagagaggcagggtcgagattgcgccaaacagaaatacgccccttagaatcttctcacgagttcttagctgc

SEQ ID NO: 125386 - DNA, 96 bp, Homo sapiens; identical to SEQ ID NO: 93541
  misc_feature 1..96: note = chr5:178108636-178108732
  misc_feature 1..96: note = Hypo
  source 1..96: mol_type = genomic DNA

SEQ ID NO: 125387 - DNA, 153 bp, Homo sapiens; identical to SEQ ID NO: 40671
  misc_feature 1..153: note = chr5:178112320-178112473
  misc_feature 1..153: note = Hypo
  source 1..153: mol_type = genomic DNA

SEQ ID NO: 125388 - DNA, 22 bp, Homo sapiens
  misc_feature 1..22: note = chr5:178117247-178117269
  misc_feature 1..22: note = Hypo
  source 1..22: mol_type = genomic DNA
tatttatcgcctcacatagtta

SEQ ID NO: 125389 - DNA, 176 bp, Homo sapiens; identical to SEQ ID NO: 93544
  misc_feature 1..176: note = chr5:178194091-178194267
  misc_feature 1..176: note = Hypo
  source 1..176: mol_type = genomic DNA

SEQ ID NO: 125390 - DNA, 30 bp, Homo sapiens; identical to SEQ ID NO: 93545
  misc_feature 1..30: note = chr5:178195637-178195667
  misc_feature 1..30: note = Hypo
  source 1..30: mol_type = genomic DNA

SEQ ID NO: 125391 - DNA, 90 bp, Homo sapiens; identical to SEQ ID NO: 93546
  misc_feature 1..90: note = chr5:178216871-178216961
  misc_feature 1..90: note = Hypo
  source 1..90: mol_type = genomic DNA

SEQ ID NO: 125392 - DNA, 165 bp, Homo sapiens; identical to SEQ ID NO: 40672
  misc_feature 1..165: note = chr5:178288343-178288508
  misc_feature 1..165: note = Hypo
  source 1..165: mol_type = genomic DNA

SEQ ID NO: 125393 - DNA, 81 bp, Homo sapiens
  misc_feature 1..81: note = chr5:178323168-178323249
  misc_feature 1..81: note = Hyper
  source 1..81: mol_type = genomic DNA
ttccccaggagctggcggcgggagcacgctggcagctgagtgtccttcggcgctgtcctgggcaggcgccgaggtggaatc

SEQ ID NO: 125394 - DNA, 502 bp, Homo sapiens
  misc_feature 1..502: note = chr5:178367881-178368383
  misc_feature 1..502: note = Hyper
  source 1..502: mol_type = genomic DNA
ccatcttcagcttttcgctgatctgcatcttcctgcgccttagtgcaaggcagagacctggttctaaagcgaacggaacggaaccgattctgtaagttgcaatgagcgcgctgaggtcggcgtggaggggtctctgggaaaggtagtttccgcgcctaaagcgccggggccgggccctgttcccgcaggcgcaaggcagcactgtctccgccgattgtccctctgggaagtggagtctggccggcggaactgcagcagccctgagacttgtgggaattcggcccaagggttcccagggcaacgcgcaagcgcagttcggctcccggctgcagactccagctcattgtgttctgactgcgatgtggcgcttgcgatctctcgccgccggcagaggctcctcgaagagcgacacggggctgaccaggcacggtggtcaaagccgcagagggagagcgggagcggtcgtgaggtcgtctggggagaagggcggaggcaaagccga

SEQ ID NO: 125395 - DNA, 30 bp, Homo sapiens; identical to SEQ ID NO: 40673
  misc_feature 1..30: note = chr5:178373124-178373154
  misc_feature 1..30: note = Hypo
  source 1..30: mol_type = genomic DNA

SEQ ID NO: 125396 - DNA, 30 bp, Homo sapiens; identical to SEQ ID NO: 93551
  misc_feature 1..30: note = chr5:178400566-178400596
  misc_feature 1..30: note = Hypo
  source 1..30: mol_type = genomic DNA

SEQ ID NO: 125397 - DNA, 94 bp, Homo sapiens; identical to SEQ ID NO: 93552
  misc_feature 1..94: note = chr5:178409975-178410069
  misc_feature 1..94: note = Hypo
  source 1..94: mol_type = genomic DNA

SEQ ID NO: 125398 - DNA, 141 bp, Homo sapiens; identical to SEQ ID NO: 93553
  misc_feature 1..141: note = chr5:178411620-178411761
  misc_feature 1..141: note = Hypo
  source 1..141: mol_type = genomic DNA

SEQ ID NO: 125399 - DNA, 34 bp, Homo sapiens; identical to SEQ ID NO: 93554
  misc_feature 1..34: note = chr5:178414393-178414427
  misc_feature 1..34: note = Hypo
  source 1..34: mol_type = genomic DNA

SEQ ID NO: 125400 - DNA, 164 bp, Homo sapiens; identical to SEQ ID NO: 93555
  misc_feature 1..164: note = chr5:178416046-178416210
  misc_feature 1..164: note = Hypo
  source 1..164: mol_type = genomic DNA

SEQ ID NO: 125401 - DNA, 549 bp, Homo sapiens
  misc_feature 1..549: note = chr5:178421464-178422013
  misc_feature 1..549: note = Hyper
  source 1..549: mol_type = genomic DNA
cgaccatgatggagacggagctggccgaggcgcccacgacggccacgacgcgctcggggggcgcggggcgcagcggagggacgcctcccgggcagcgcacgcccacctcgtcgccgtcgccgcggccgcggatcagcgcctgcacgaagctcagcgcctgctccagcgcgtaggtgtcccgcgagcaggtgtccagcagccgcgcgcccaggcgcacgccgggcagcagctcggggtcggcgttgacgcggtccagcgcgtacagcatggcctccagccggtgcacgccctgctccttcttcagctgcccgcacgcccggcccgccgcgccccgcgcgtgcaccgggaacaggccgcccagcgtcaggccgcccgccaggcgcacagagcccgccgcgcgcgccaggcccgcctgcgccagccacgccagcggcagcagcgccacgagcagcggctcccgggctctccggggccgcgccatcggctcgtctagcgggctgcggggagacagaggggcggggagcgctctgagggcgggggaaggagagc

SEQ ID NO: 125402 - DNA, 43 bp, Homo sapiens; identical to SEQ ID NO: 30176
  misc_feature 1..43: note = chr5:178422264-178422307
  misc_feature 1..43: note = Hyper
  source 1..43: mol_type = genomic DNA

SEQ ID NO: 125403 - DNA, 574 bp, Homo sapiens; identical to SEQ ID NO: 93557
  misc_feature 1..574: note = chr5:178450579-178451153
  misc_feature 1..574: note = Hyper
  source 1..574: mol_type = genomic DNA

SEQ ID NO: 125404 - DNA, 102 bp, Homo sapiens; identical to SEQ ID NO: 93558
  misc_feature 1..102: note = chr5:178478883-178478985
  misc_feature 1..102: note = Hypo
  source 1..102: mol_type = genomic DNA

SEQ ID NO: 125405 - DNA, 90 bp, Homo sapiens; identical to SEQ ID NO: 40678
  misc_feature 1..90: note = chr5:178481810-178481900
  misc_feature 1..90: note = Hypo
  source 1..90: mol_type = genomic DNA

SEQ ID NO: 125406 - DNA, 669 bp, Homo sapiens
  misc_feature 1..669: note = chr5:178487107-178487776
  misc_feature 1..669: note = Hyper
  source 1..669: mol_type = genomic DNA
aatgaatctaatttccggttttgttttttcaaactactccgcttgcttaacaagtgcgcgggctgtaggcagcacggccagcagctggagacctcctgcctcgtgtgcggcgtgcgtactccctcgcactgcagcccctccgcgcactgtcgcctttgagagctctcgttggcggaggcggttcctctcccggagttcgcagcgcgcaccgcggcgtcccctgggaagtgtagtcggcgtggggccggaggcatgccgggagtggtagttctcccgcggttggcggggtttcggggacagctcgcggcctttcgggggttctcctggcttgggccatccaggcttggctaggattgccggcctggggttgaggcgctcgcagtggtctcttccgggccggggtggatccgggcctctccagcgagtgggcggcgtgcagcctcgtctgggcttctgggaccagccctacgcggctcgggccccttggccactgggtcccggggcgccgtccgcgagcggcctggactgccggagacccgcgggagggagcgcctcgccaggtgagctgggtgcgccgggccgctggggtggggatgccagccttttgtcgttgttcattctgcgattttcttctgtgcattttcttctgagtaacggaaataataaaag

SEQ ID NO: 125407 - DNA, 117 bp, Homo sapiens; identical to SEQ ID NO: 93562
  misc_feature 1..117: note = chr5:178488196-178488313
  misc_feature 1..117: note = Hypo
  source 1..117: mol_type = genomic DNA

SEQ ID NO: 125408 - DNA, 77 bp, Homo sapiens; identical to SEQ ID NO: 93563
  misc_feature 1..77: note = chr5:178551846-178551923
  misc_feature 1..77: note = Hypo
  source 1..77: mol_type = genomic DNA

SEQ ID NO: 125409 - DNA, 30 bp, Homo sapiens; identical to SEQ ID NO: 93564
  misc_feature 1..30: note = chr5:178556809-178556839
  misc_feature 1..30: note = Hypo
  source 1..30: mol_type = genomic DNA

SEQ ID NO: 125410 - DNA, 164 bp, Homo sapiens; identical to SEQ ID NO: 93565
  misc_feature 1..164: note = chr5:178561609-178561773
  misc_feature 1..164: note = Hypo
  source 1..164: mol_type = genomic DNA

SEQ ID NO: 125411 - DNA, 41 bp, Homo sapiens; identical to SEQ ID NO: 40680
  misc_feature 1..41: note = chr5:178565442-178565483
  misc_feature 1..41: note = Hypo
  source 1..41: mol_type = genomic DNA

SEQ ID NO: 125412 - DNA, 152 bp, Homo sapiens; identical to SEQ ID NO: 93567
  misc_feature 1..152: note = chr5:178566307-178566459
  misc_feature 1..152: note = Hypo
  source 1..152: mol_type = genomic DNA

SEQ ID NO: 125413 - DNA, 145 bp, Homo sapiens; identical to SEQ ID NO: 40681
  misc_feature 1..145: note = chr5:178576381-178576526
  misc_feature 1..145: note = Hypo
  source 1..145: mol_type = genomic DNA

SEQ ID NO: 125414 - DNA, 30 bp, Homo sapiens; identical to SEQ ID NO: 93569
  misc_feature 1..30: note = chr5:178580513-178580543
  misc_feature 1..30: note = Hypo
  source 1..30: mol_type = genomic DNA

SEQ ID NO: 125415 - DNA, 403 bp, Homo sapiens
  misc_feature 1..403: note = chr5:178594068-178594471
  misc_feature 1..403: note = Hyper
  source 1..403: mol_type = genomic DNA
ccagcaggaagtcaccgtccgcaaggagcgccccgctaggctcaggcttggcacacgacacctcgcttccacttcattttcctaccttccggatgacgaactgcgtctcagacaactgaaaggactcgcctgagtcccacagccggaaagaggtcggggtgctgccccccgcgcggggcgggcagaggaagggccgggcccgagcggccaccaggtggcgctgctgccgcgagaacagcggcccgggccggggacgcacccggcgcccagactccgcggccgcacccgggctcccggggccccagcggccccaagacagcctctgggcctcaccctaaatacatcaattatgacctgagcaaaaagttctgttccaatcgttgctctccgacatttccattgt

SEQ ID NO: 125416 - DNA, 186 bp, Homo sapiens; identical to SEQ ID NO: 93571
  misc_feature 1..186: note = chr5:178612233-178612419
  misc_feature 1..186: note = Hypo
  source 1..186: mol_type = genomic DNA

SEQ ID NO: 125417 - DNA, 45 bp, Homo sapiens; identical to SEQ ID NO: 93572
  misc_feature 1..45: note = chr5:178634584-178634629
  misc_feature 1..45: note = Hypo
  source 1..45: mol_type = genomic DNA

SEQ ID NO: 125418 - DNA, 30 bp, Homo sapiens; identical to SEQ ID NO: 93573
  misc_feature 1..30: note = chr5:178635361-178635391
  misc_feature 1..30: note = Hypo
  source 1..30: mol_type = genomic DNA

SEQ ID NO: 125419 - DNA, 210 bp, Homo sapiens; identical to SEQ ID NO: 40682
  misc_feature 1..210: note = chr5:178655698-178655908
  misc_feature 1..210: note = Hypo
  source 1..210: mol_type = genomic DNA

SEQ ID NO: 125420 - DNA, 99 bp, Homo sapiens; identical to SEQ ID NO: 93575
  misc_feature 1..99: note = chr5:178665413-178665512
  misc_feature 1..99: note = Hypo
  source 1..99: mol_type = genomic DNA

SEQ ID NO: 125421 - DNA, 128 bp, Homo sapiens; identical to SEQ ID NO: 93576
  misc_feature 1..128: note = chr5:178684538-178684666
  misc_feature 1..128: note = Hypo
  source 1..128: mol_type = genomic DNA

SEQ ID NO: 125422 - DNA, 43 bp, Homo sapiens; identical to SEQ ID NO: 93577
  misc_feature 1..43: note = chr5:178699920-178699963
  misc_feature 1..43: note = Hypo
  source 1..43: mol_type = genomic DNA

SEQ ID NO: 125423 - DNA, 64 bp, Homo sapiens; identical to SEQ ID NO: 93578
  misc_feature 1..64: note = chr5:178737203-178737267
  misc_feature 1..64: note = Hypo
  source 1..64: mol_type = genomic DNA

SEQ ID NO: 125424 - DNA, 48 bp, Homo sapiens; identical to SEQ ID NO: 93579
  misc_feature 1..48: note = chr5:178739679-178739727
  misc_feature 1..48: note = Hypo
  source 1..48: mol_type = genomic DNA

SEQ ID NO: 125425 - DNA, 74 bp, Homo sapiens; identical to SEQ ID NO: 93580
  misc_feature 1..74: note = chr5:178740136-178740210
  misc_feature 1..74: note = Hypo
  source 1..74: mol_type = genomic DNA

SEQ ID NO: 125426 - DNA, 2093 bp, Homo sapiens
  misc_feature 1..2093: note = chr5:178770743-178772836
  misc_feature 1..2093: note = Hyper
  source 1..2093: mol_type = genomic DNA
ggagctagagaagtgcgtactcaccagcccatcgcagttgctgagcgccacagaggaggcttcggctaggccggccacgtctccgacgtagagacagctcccgagcaggggctccacgcgggtggtgcccttctcgccctgccactccatagtggccccgggcgccacgaggcgggcgttgggccgcagccgcaggtgcaggtctcggccaaagaccgtgacattgtagaagaggtgactgccaggctcctcctcgttgcctccggggaagctcggggtccggaccggggcggccctgcgggctcgtacccctgctctggacgtagctgccgacaccacgtgggacaccaagcggccctgggcgtcagtgcgcacgggcaccgccaggatgcgctccgctccgtgccccaggggcccgcctgcaacgggaaggggcgttagatcggcggagaccacggagccccagtgcctcagagacccgccggcaagccacgcccccccagaccccgccccactgcgaagggaaggggcattccgccaggcgaccccagaagccagcctgcacctccccggctttcctgcaaccgggaaggggcgttaacagggccaccactccggggctccgccactccccagccgttccctcctccggagaccttgcctgccaagagctctgccccctgccccgttcagggttggggctcggtgggaacctccccgtgcccgaagggacgaccccgtcagagagtcccccgacccttgcacctaccgtccttggcaggacgtggagctgctcggaagccattccgggttggcccccttacccgtgtgccacgacccctcggcgggcccctgccgcccgagtgccctcaccgccagcctccggagcggcggagtctcggcttccccgagcacgagcggcctgtcctgcctgtccagctcccgctcagcccgctgccggccccgtctccccgagcgcccgaggactgggaggggtggaacagggtccctccgatctccggggattccctgcggggcgccccaaccaatccttagggcccaaggctacgcgctcggcagccggctcctccggagcgtccccggacgcgagccccggcgccgcctcgccctggctcccccctcggacccgctggggctgactctgcgctcttggccgcggggcttttcccggccctccgtccccaccctccgcgactcaggagccgccagtgctccgaggctcccccggcccaaggcgctcgggggcggtgcggggcgccccctgcgcgaccaacccggccccgaagttggccaacttggccccgggcggggcgcgcggagtttgcccaagtcaggctggacgacgcctggggagggggcggcggggcacgcgggacagggccaggccggcgggggtcccggggagtaggggccgggccgcacctacctggggggtcggcggcggcggcgagcctggcgttcgcgggcggcggcggcggcggcaggagcggcggcggcagcagcagcagcagcagcagcagcgcggggcagagcaggcggcgagcggctcccgccggcggatccatggcagccggactgcagccggggccccgcactcgcagccggcgcgaaagttccccgcgagccgcccagcccacatctgggggcagctggagccgcccgcagctgcagcaccgcagggcgcggggcggaggaggcgaggcgcggaggggcgggcgggggagcgcggagggaaggcggggagagggaaggagcgagcgagcgagggaggcaggcgggagggagggaggcgagcgagggggagggcggggacggcgggcgcctcagcctgcggtgacccggcgcatcttggcgcggccgccgccgccgcccgcttccctcttcgcgccgccgtcgccgcggtgccgggctcgcagcgaagcagagacaccccgaggcggcggcagagaagcgccgcgggccgggccgggggagccccgccgccagccaccccaggggcacaacctccgaggagcggcgccggccgaacgtccccacctagagagcccttggggtgccgggtcccacccatc

SEQ ID NO: 125427 - DNA, 30 bp, Homo sapiens; identical to SEQ ID NO: 93587
  misc_feature 1..30: note = chr5:178788838-178788868
  misc_feature 1..30: note = Hypo
  source 1..30: mol_type = genomic DNA

SEQ ID NO: 125428 - DNA, 30 bp, Homo sapiens; identical to SEQ ID NO: 93588
  misc_feature 1..30: note = chr5:178794198-178794228
  misc_feature 1..30: note = Hypo
  source 1..30: mol_type = genomic DNA

SEQ ID NO: 125429 - DNA, 219 bp, Homo sapiens; identical to SEQ ID NO: 93589
  misc_feature 1..219: note = chr5:178836785-178837004
  misc_feature 1..219: note = Hypo
  source 1..219: mol_type = genomic DNA

SEQ ID NO: 125430 - DNA, 49 bp, Homo sapiens; identical to SEQ ID NO: 40685
  misc_feature 1..49: note = chr5:178854790-178854839
  misc_feature 1..49: note = Hypo
  source 1..49: mol_type = genomic DNA

SEQ ID NO: 125431 - DNA, 17 bp, Homo sapiens
  misc_feature 1..17: note = chr5:178861589-178861606
  misc_feature 1..17: note = Hypo
  source 1..17: mol_type = genomic DNA
tttttttttttgagacg

SEQ ID NO: 125432 - DNA, 96 bp, Homo sapiens; identical to SEQ ID NO: 93592
  misc_feature 1..96: note = chr5:178877445-178877541
  misc_feature 1..96: note = Hypo
  source 1..96: mol_type = genomic DNA

SEQ ID NO: 125433 - DNA, 90 bp, Homo sapiens; identical to SEQ ID NO: 93593
  misc_feature 1..90: note = chr5:178878660-178878750
  misc_feature 1..90: note = Hypo
  source 1..90: mol_type = genomic DNA

SEQ ID NO: 125434 - DNA, 30 bp, Homo sapiens; identical to SEQ ID NO: 40687
  misc_feature 1..30: note = chr5:178882544-178882574
  misc_feature 1..30: note = Hypo
  source 1..30: mol_type = genomic DNA

SEQ ID NO: 125435 - DNA, 86 bp, Homo sapiens; identical to SEQ ID NO: 93595
  misc_feature 1..86: note = chr5:178882941-178883027
  misc_feature 1..86: note = Hypo
  source 1..86: mol_type = genomic DNA

SEQ ID NO: 125436 - DNA, 30 bp, Homo sapiens; identical to SEQ ID NO: 93596
  misc_feature 1..30: note = chr5:178883436-178883466
  misc_feature 1..30: note = Hypo
  source 1..30: mol_type = genomic DNA

SEQ ID NO: 125437 - DNA, 37 bp, Homo sapiens; identical to SEQ ID NO: 93597
  misc_feature 1..37: note = chr5:178907047-178907084
  misc_feature 1..37: note = Hypo
  source 1..37: mol_type = genomic DNA

SEQ ID NO: 125438 - DNA, 75 bp, Homo sapiens; identical to SEQ ID NO: 93598
  misc_feature 1..75: note = chr5:178913784-178913859
  misc_feature 1..75: note = Hypo
  source 1..75: mol_type = genomic DNA

SEQ ID NO: 125439 - DNA, 386 bp, Homo sapiens
  misc_feature 1..386: note = chr5:178957560-178957946
  misc_feature 1..386: note = Hyper
  source 1..386: mol_type = genomic DNA
cgccgggtctgtggacgcggatccgaatcggagcttccgagggtgatctgagatccaaagtcaggagtcttctgcatcctgccctttgtcagcgctggtcctcatttcacctgcccagggccttcaggaggggcgacactctccggctgcgggcggcccagcgctcgcccccctcggccccacgtactcttcctgcctcgcccccatcgccctcctccggcttcccgcgcctcccggggctctgcgcttgcgtccagggcgccctctccggggacaatgggcgggtgcttcgcaggctgcagtcagggccgacttcacccggcgaggacagggcgaggcgctgggcccagaggtatgtttgaaacgattcgcgtatgtgaatctac

SEQ ID NO: 125440 - DNA, 19 bp, Homo sapiens
  misc_feature 1..19: note = chr5:178969579-178969598
  misc_feature 1..19: note = Hypo
  source 1..19: mol_type = genomic DNA
agaatgggccaggtgcggt

SEQ ID NO: 125441 - DNA, 120 bp, Homo sapiens; identical to SEQ ID NO: 93601
  misc_feature 1..120: note = chr5:178978788-178978908
  misc_feature 1..120: note = Hypo
  source 1..120: mol_type = genomic DNA

SEQ ID NO: 125442 - DNA, 35 bp, Homo sapiens; identical to SEQ ID NO: 40689
  misc_feature 1..35: note = chr5:178987430-178987465
  misc_feature 1..35: note = Hypo
  source 1..35: mol_type = genomic DNA

SEQ ID NO: 125443 - DNA, 379 bp, Homo sapiens; identical to SEQ ID NO: 93603
  misc_feature 1..379: note = chr5:179213899-179214278
  misc_feature 1..379: note = Hypo
  source 1..379: mol_type = genomic DNA

SEQ ID NO: 125444 - DNA, 495 bp, Homo sapiens
  misc_feature 1..495: note = chr5:179243847-179244342
  misc_feature 1..495: note = Hyper
  source 1..495: mol_type = genomic DNA
ccccagcagtgcccccgggtctccggccacccggtgacggagggagggagaggctggcgagggggcggcgccttaggtcccagcgcgacccgcctctcagcccctcccgccggctacagccgcgcgggacggggcagggacctcgagaacaccggggacttgcgggccggtggccccgggcaggccacttctgacgcgggtgcgaggccttccgcgggcgtgcacggttgggccggagccgcgccgggggccgggacacgcctggggtcagcgctggcgtcgccgctcgggtggggtgggccgggttcgggtccagtctcctccccacgggcggcccgcgccccgtcttccagtgacccccacatcccttgcgccccgagctggaacttcggcaggttctgccccgggccgcgcgcgctttctggggaccagggctgtggttcctgctccgcgtcgtgcctttagacaccgccgggcgttcgtcctccatccctc

SEQ ID NO: 125445 - DNA, 30 bp, Homo sapiens; identical to SEQ ID NO: 93606
  misc_feature 1..30: note = chr5:179263484-179263514
  misc_feature 1..30: note = Hypo
  source 1..30: mol_type = genomic DNA

SEQ ID NO: 125446 - DNA, 30 bp, Homo sapiens; identical to SEQ ID NO: 93607
  misc_feature 1..30: note = chr5:179401303-179401333
  misc_feature 1..30: note = Hypo
  source 1..30: mol_type = genomic DNA

SEQ ID NO: 125447 - DNA, 50 bp, Homo sapiens; identical to SEQ ID NO: 40691
  misc_feature 1..50: note = chr5:179401725-179401775
  misc_feature 1..50: note = Hypo
  source 1..50: mol_type = genomic DNA

SEQ ID NO: 125448 - DNA, 30 bp, Homo sapiens; identical to SEQ ID NO: 93609
  misc_feature 1..30: note = chr5:179448856-179448886
  misc_feature 1..30: note = Hypo
  source 1..30: mol_type = genomic DNA

SEQ ID NO: 125449 - DNA, 109 bp, Homo sapiens; identical to SEQ ID NO: 93612
  misc_feature 1..109: note = chr5:179498254-179498363
  misc_feature 1..109: note = Hyper
  source 1..109: mol_type = genomic DNA

SEQ ID NO: 125450 - DNA, 30 bp, Homo sapiens; identical to SEQ ID NO: 30192
  misc_feature 1..30: note = chr5:179498867-179498897
  misc_feature 1..30: note = Hyper
  source 1..30: mol_type = genomic DNA

SEQ ID NO: 125451 - DNA, 30 bp, Homo sapiens; identical to SEQ ID NO: 93614
  misc_feature 1..30: note = chr5:179499226-179499256
  misc_feature 1..30: note = Hyper
  source 1..30: mol_type = genomic DNA

SEQ ID NO: 125452 - DNA, 34 bp, Homo sapiens; identical to SEQ ID NO: 93616
  misc_feature 1..34: note = chr5:179535480-179535514
  misc_feature 1..34: note = Hypo
  source 1..34: mol_type = genomic DNA

SEQ ID NO: 125453 - DNA, 30 bp, Homo sapiens; identical to SEQ ID NO: 93617
  misc_feature 1..30: note = chr5:179546275-179546305
  misc_feature 1..30: note = Hypo
  source 1..30: mol_type = genomic DNA

SEQ ID NO: 125454 - DNA, 35 bp, Homo sapiens; identical to SEQ ID NO: 93618
  misc_feature 1..35: note = chr5:179557921-179557956
  misc_feature 1..35: note = Hypo
  source 1..35: mol_type = genomic DNA

SEQ ID NO: 125455 - DNA, 333 bp, Homo sapiens; identical to SEQ ID NO: 93619
  misc_feature 1..333: note = chr5:179564509-179564842
  misc_feature 1..333: note = Hypo
  source 1..333: mol_type = genomic DNA

SEQ ID NO: 125456 - DNA, 30 bp, Homo sapiens; identical to SEQ ID NO: 93620
  misc_feature 1..30: note = chr5:179621876-179621906
  misc_feature 1..30: note = Hypo
  source 1..30: mol_type = genomic DNA

SEQ ID NO: 125457 - DNA, 335 bp, Homo sapiens; identical to SEQ ID NO: 93621
  misc_feature 1..335: note = chr5:179635756-179636091
  misc_feature 1..335: note = Hyper
  source 1..335: mol_type = genomic DNA

SEQ ID NO: 125458 - DNA, 155 bp, Homo sapiens
  misc_feature 1..155: note = chr5:179636151-179636306
  misc_feature 1..155: note = Hyper
  source 1..155: mol_type = genomic DNA
cgaccgcccggctcccagcgcagcccgcacgagcgcctggcggcggccccggagcaacgcggcgctgcgccccctcgtggcactcaggcagcgcggagcgggcggggcgcgggggtggagctgcgggagcccgcgggcggcgctgcacaccaggg

SEQ ID NO: 125459 - DNA, 30 bp, Homo sapiens; identical to SEQ ID NO: 93624
  misc_feature 1..30: note = chr5:179653659-179653689
  misc_feature 1..30: note = Hypo
  source 1..30: mol_type = genomic DNA

SEQ ID NO: 125460 - DNA, 157 bp, Homo sapiens; identical to SEQ ID NO: 93625
  misc_feature 1..157: note = chr5:179742465-179742622
  misc_feature 1..157: note = Hypo
  source 1..157: mol_type = genomic DNA

SEQ ID NO: 125461 - DNA, 54 bp, Homo sapiens; identical to SEQ ID NO: 93626
  misc_feature 1..54: note = chr5:179779378-179779432
  misc_feature 1..54: note = Hyper
  source 1..54: mol_type = genomic DNA

SEQ ID NO: 125462 - DNA, 1644 bp, Homo sapiens
  misc_feature 1..1644: note = chr5:179779648-179781292
  misc_feature 1..1644: note = Hyper
  source 1..1644: mol_type = genomic DNA
acgttcctttggggtcgcgaggaggacgcgcaggccctgcctgaggcactgacgcagcgggggcgaccgggcgggctgcggggacggcggggcggggtcgcctctcctctcctcggtgggcgcggcgggctgagtcgggatgggcgccccgcactcgggatgcgccggcctgcgcgtggccgcctttgtgggcgactgggagacgtggaggagagcgacctcggtcggcatggggtggggacccctctgttacggggtccaggccggaccggaccaggtccctcccctccgtggggaccgggcctcggtccccctcactgtgtccgagaccaggagtcgggttgggcatcccccacccacacctccgagacggccactcggggaacgcgggtgaggggcagccaggcccggccgacgacagcccctcggtaggggcccggggcagatcggcgcccccagccaggtcctcggcgcctgcttgcgggcggaggcgcggagaggctgcggcgccgggacccgcggacggcgtggaggaggcggctcgggcgggcgcggcactcaccgcacatcgtggctgcttctcgggctccttcgcggctcgagggggtctgcccgttcggacgctggggctcctccgtgggctcctccgtgggctccgtgggctccgtgggctccgcgggctccagctcccgtccgctcggcctccagcccttataacccggagccctccgagagggcggggaagggggcggggaaggggcggggcttcccccgcccgcctgctcccattggcccccggttgtcgtgacaacgacgggacccggcccccaggagccagggaggggggccgaggggcggctcccaggcgcgggtcgggcgtgtaaggctggggcgccgggcgccagatcccggagcggggcttagggcaaccaacggcccgagttcagaccccgactcaaccagagtaggcgtggaagccgggcagggcccgatcgcgctgtgcctccgctttcccgtctgtgaaacggggctacccagggaagctccctcccacggggtgctgagaagtcagacgggccgcgtaaggggcagagcgaggggtccggcatcactcgcgcgctccggaaacccgcgtgagccgctgttcctgccgcgctcccatctgagtgacaggcttgtttcagagctccgcagacctctaagcctggccctcaccctgcgtggagagaacgcccgggcttggcggagagacgagaaaaccgaggctcccggaggcagacaaggactctgccaaaaccggacgccgcggcggtggcagaattcgaccctgggatttgccgcggagcccgagcttgaaggcgagggttccgcaggttgtgaacgaagctggaggcgccccaggaagccccgaccccacccgcgccgagctgccccctccccagatctgcctcgcgctgcaggcccgcgagggacccgggggttcctacgcctggggtcggaatccgaccccccagtgaggcaccaaggcccgcgtttctccgccctggttcccggccgtccctcccgttccccctgcactctgggcccctcgtctcccgaggaaggtcacgagaaccggcccaacgtttgcgcactttgaagttt

SEQ ID NO: 125463 - DNA, 34 bp, Homo sapiens; identical to SEQ ID NO: 93630
  misc_feature 1..34: note = chr5:179824602-179824636
  misc_feature 1..34: note = Hypo
  source 1..34: mol_type = genomic DNA

SEQ ID NO: 125464 - DNA, 135 bp, Homo sapiens; identical to SEQ ID NO: 93631
  misc_feature 1..135: note = chr5:179867486-179867621
  misc_feature 1..135: note = Hyper
  source 1..135: mol_type = genomic DNA

SEQ ID NO: 125465 - DNA, 43 bp, Homo sapiens; identical to SEQ ID NO: 93632
  misc_feature 1..43: note = chr5:180011938-180011981
  misc_feature 1..43: note = Hypo
  source 1..43: mol_type = genomic DNA

SEQ ID NO: 125466 - DNA, 1561 bp, Homo sapiens
  misc_feature 1..1561: note = chr5:180017118-180018679
  misc_feature 1..1561: note = Hyper
  source 1..1561: mol_type = genomic DNA
tttattgagaggggccgggggaaggggatggacggtcctccccgcggcggggttttcagccctcgcgggtgggcagcgtcttgtcctcaggtgtagatgctccagtctcggctcagccaaacactgtcagggccccctggaaagcagaagccgagcttgagtgcccccagccctgccaccaagaactcaggcgggggcgcggcagcggccggctctgtggggagcgggagcggggcggttccgctggcgtctccgggggacgcgcacccgcgcggggccatctccgccttccccgcccctgcagctcggatgcgccccacccagttcccacccggagacccgggcttctcccagggacagggcttggaggggcaggacgggaaacagccctgacgtagggccgggacacctctggtgcagttttgaggctggccgggaagggatgcccgcgcaggaagggcacccggggtgcccactttaccagcagggccttcagggccttcacggcccccacggcctggggacccagctcagccacacacttctgggagccctctatgaggtggttcacggggatgcccaggctgctcagcaggagcttcagcgggttgagggtgccgagggggttggccagggtcccggccccggcctccgccgccgactccagcgcagcgacaggctgggccacaggcttggccgagcccactaagaaagcagcagctgcaagcgaacagggaggggtcaccgcctgcgcgccggggtccccagaaggcaggtccaggacgcgcccccgcgggaggcgcccaggaaccgtcgcgccctgcccggctccccgaccgcccctccctcctgcgccgaggcctgccaggtgcgagcccccgggacacaggcgggtctggggaggcggccccgccaggagacgctgcagggtcaccggagtggcctgagggtggcggaaggaccggtgaactctgtgcagggtccgggacaggcccccaagggaggggacactcgcgctgcgccttgcaggatgaggagccggtctccagacggggggcagacgggtgtccccaggccaggggcggcctccatcccggcacgaggctggagacagccctgagagggggaggccgcgggctgcaggcgcggggccccggggtggcggagccctctgggcgccgggcgaggctggaaggacctgggatccacgatcggcgcaggcagcggcgggggcgcagcgggcgccgaggcctcaggccccaccgtgcgcgccaggagcccggggcgctcaccggagctgcaggacagggccacgcagagccccaggagggcggcgagcttcatggcgcgggggctcggggcgcgcggggaacctgcggctgcccgggcaaggccacgaggcttcttatacccggtcctcgcccctccagcgccggcctcgcccgcgctcctgagaaagccctgcccgctccgctcacggccgtgccctggccaacttcctgctgcggccggcgggccctgggaagcccgtgcccccttccctgcccgggcctcgaggact

SEQ ID NO: 125467 - DNA, 30 bp, Homo sapiens; identical to SEQ ID NO: 93636
  misc_feature 1..30: note = chr5:180019434-180019464
  misc_feature 1..30: note = Hypo
  source 1..30: mol_type = genomic DNA

SEQ ID NO: 125468 - DNA, 30 bp, Homo sapiens; identical to SEQ ID NO: 40693
  misc_feature 1..30: note = chr5:180021394-180021424
  misc_feature 1..30: note = Hypo
  source 1..30: mol_type = genomic DNA

SEQ ID NO: 125469 - DNA, 82 bp, Homo sapiens; identical to SEQ ID NO: 93638
  misc_feature 1..82: note = chr5:180028458-180028540
  misc_feature 1..82: note = Hypo
  source 1..82: mol_type = genomic DNA

SEQ ID NO: 125470 - DNA, 289 bp, Homo sapiens; identical to SEQ ID NO: 93639
  misc_feature 1..289: note = chr5:180033320-180033609
  misc_feature 1..289: note = Hypo
  source 1..289: mol_type = genomic DNA

SEQ ID NO: 125471 - DNA, 85 bp, Homo sapiens; identical to SEQ ID NO: 93640
  misc_feature 1..85: note = chr5:180041104-180041189
  misc_feature 1..85: note = Hypo
  source 1..85: mol_type = genomic DNA

SEQ ID NO: 125472 - DNA, 36 bp, Homo sapiens; identical to SEQ ID NO: 93641
  misc_feature 1..36: note = chr5:180042128-180042164
  misc_feature 1..36: note = Hypo
  source 1..36: mol_type = genomic DNA

SEQ ID NO: 125473 - DNA, 247 bp, Homo sapiens; identical to SEQ ID NO: 93642
  misc_feature 1..247: note = chr5:180046700-180046947
  misc_feature 1..247: note = Hypo
  source 1..247: mol_type = genomic DNA

SEQ ID NO: 125474 - DNA, 30 bp, Homo sapiens; identical to SEQ ID NO: 93643
  misc_feature 1..30: note = chr5:180047720-180047750
  misc_feature 1..30: note = Hypo
  source 1..30: mol_type = genomic DNA

SEQ ID NO: 125475 - DNA, 252 bp, Homo sapiens; identical to SEQ ID NO: 93644
  misc_feature 1..252: note = chr5:180052859-180053111
  misc_feature 1..252: note = Hypo
  source 1..252: mol_type = genomic DNA

SEQ ID NO: 125476 - DNA, 252 bp, Homo sapiens; identical to SEQ ID NO: 93645
  misc_feature 1..252: note = chr5:180057419-180057671
  misc_feature 1..252: note = Hypo
  source 1..252: mol_type = genomic DNA

SEQ ID NO: 125477 - DNA, 1293 bp, Homo sapiens
  misc_feature 1..1293: note = chr5:180075791-180077084
  misc_feature 1..1293: note = Hyper
  source 1..1293: mol_type = genomic DNA
tcctcagctggccttcgaggcccctgtcccctcaaatccggggacccctggccttccgccccttctgcggcgctgacagcccgcgattcgcctcctcaagattcgtctcaagtgccagcgtgcacctgcacccgtccgcctcgggcgcgcggtggtccccggcccctgtccccgccgtcgccggccacggggagggggaagcccgcctcgagcgccctctgggggaccgaccgcgagcggaggcgctgggcgtcgggaagtgcgcacccaagtccggggcccggccgggatggatctccggcgcgcgtgggtcgggacggcgcggcgcggggaccccgcggggaagcgagtaagggcgcgaaggatccgggctcagcgcgcagcccggcagggcccggctccgaggacgcggagccaccgacggagacgcggattcaggggccgggagagctacccctgcgccgaggcgcggcccggccgccctggccctgacccggctgcggtccccgcccgccccttcctcatcccgaggtcccgcgccccaagcgccgtgctcccctcaggcgtccgcgcaccagggccaccgtgtcccccgcccgtacccggcggagcggtctcagcgcccgccccaggtgcgcggtaccccctccccggccagccccacgctcgggcgggtggcccgttcgccgcgctcaccgtccaggagtcccaggcagagccacagtcgcaggcacagcgcggcgccccgctgcatctccggccgctgcgcgtgggtccgacccgagcggccgcggctcggggctgaaagtgtccgcgcgggcgccggctggcctggggcggggcggggcggggcgggggccggaggcgggcccgggattcaggccgctccccgcgcccccctccccccgtccctcccagcccgccgcggggcgtccggtgcacccgagcagtgcgcgctccgcaccacagggtccgggccccctcctgggcggctccgggcgcggggacgcgggtaacgcagacggtctcgcgatgcgctccggaggtgatggagcctggtgggcaaaggggagcaaaatgcggcacgcgctcttttccgtcctttctttccatcggtaaaatctagactaaacaagaaagcaatccttgtaaaaatagtatgttacatctttgaaaatagtggcaccagccggcgtaacatagggagacccagtctcaaaaataaacaagcaaataaataaaataatacgccgagcttggttgtgcgcgcctgtaatcccagcttctcggggg

SEQ ID NO: 125478 - DNA, 744 bp, Homo sapiens
  misc_feature 1..744: note = chr5:180100588-180101332
  misc_feature 1..744: note = Hyper
  source 1..744: mol_type = genomic DNA
cctgaggcgggaactcgggtttttaaggcgtttttgtcgcttccagctcggtttcccctgtggtcagttggagccagggtggggaatctgcagcttgcagaggggaccactgcgcctcctgcctgaggcgggctggggggtcgttgtcctcgcagcgttaaggcgagtctgggacaggaccccggcaccccctccggatctgtggcatcctccaggactccggcgcaggacgcgctccaggagccgctccttcagggcctccggtgcgcgcagtccgggcgccggacgagctcctttatcagaaagggcagccgcagagcccgcgtgtgcgcgatgtggctgcgggtggggagcgggcggcgggcccgggacaccgcggccactgttctagccccgcctgggccgcctgaccgcggctccgctgcgccgcagccccgcgcccctctggctcctgttcccgggcgcggggagaaggcggcggggcgcgcctgggcccgcgcgggtgcgaacgcgaggtctttcctgggtgctcccaggtcggaggattcccagggcgggggccatcagggtggcgaggaaccggcagggaccagcctccgctaggaccgcgctcgtggagcggggaggctcctggatcacgtcatctcctgctcctcacagatgcgggaggaaaaacggaggctcccagggcccggttaactcgctctcttgacaaagaacctcctggaccggactccagccagg

SEQ ID NO: 125479 - DNA, 196 bp, Homo sapiens; identical to SEQ ID NO: 93652
  misc_feature 1..196: note = chr5:180111784-180111980
  misc_feature 1..196: note = Hypo
  source 1..196: mol_type = genomic DNA

SEQ ID NO: 125480 - DNA, 30 bp, Homo sapiens; identical to SEQ ID NO: 93653
  misc_feature 1..30: note = chr5:180159486-180159516
  misc_feature 1..30: note = Hypo
  source 1..30: mol_type = genomic DNA

SEQ ID NO: 125481 - DNA, 23 bp, Homo sapiens
  misc_feature 1..23: note = chr5:180169497-180169520
  misc_feature 1..23: note = Hypo
  source 1..23: mol_type = genomic DNA
cggaagtgcggggatgacaggcg

SEQ ID NO: 125482 - DNA, 225 bp, Homo sapiens; identical to SEQ ID NO: 93655
  misc_feature 1..225: note = chr5:180294196-180294421
  misc_feature 1..225: note = Hypo
  source 1..225: mol_type = genomic DNA

SEQ ID NO: 125483 - DNA, 30 bp, Homo sapiens; identical to SEQ ID NO: 40699
  misc_feature 1..30: note = chr5:180326126-180326156
  misc_feature 1..30: note = Hypo
  source 1..30: mol_type = genomic DNA

SEQ ID NO: 125484 - DNA, 64 bp, Homo sapiens; identical to SEQ ID NO: 93657
  misc_feature 1..64: note = chr5:180480238-180480302
  misc_feature 1..64: note = Hyper
  source 1..64: mol_type = genomic DNA

SEQ ID NO: 125485 - DNA, 36 bp, Homo sapiens
  misc_feature 1..36: note = chr5:180486849-180486885
  misc_feature 1..36: note = Hyper
  source 1..36: mol_type = genomic DNA
ggactggtggtgaggcgccctcgtggccgcgggact

SEQ ID NO: 125486 - DNA, 496 bp, Homo sapiens
  misc_feature 1..496: note = chr5:180527353-180527849
  misc_feature 1..496: note = Hyper
  source 1..496: mol_type = genomic DNA
atctcccacccttgccgccctctggatccagcgtccaccgagcactttttccagttccttcattctgcgcgcgagtcagcttgctgtgtagggacagaagatgacgaagtgaattcctgcagcccgccgagctgttgctgtcgccctgggagcagggcacgctcttgaccatccactcgcagatctgcgacagcgcgagccgcttctccgccgagctctcgtcggccctggtgctgaggtcggcgtgggacaggctgcgcgacgcggtgcgacgggacgagctgcccctgcgctgctgcccggcggaggcggggtcccgggtgggtgctgcggcgcggcgtcccggcgtccgcaaaagtcctcgctgtcctgcagcaggctcgggttgctcatgaagtcggcgctgacgggcgggactggaggtggccgcgtgggacccgcgactggaaatccgggtgcacctccgccccccggggcgcttcggccttggggtccc

SEQ ID NO: 125487 - DNA, 34 bp, Homo sapiens; identical to SEQ ID NO: 93661
  misc_feature 1..34: note = chr5:180530753-180530787
  misc_feature 1..34: note = Hyper
  source 1..34: mol_type = genomic DNA

SEQ ID NO: 125488 - DNA, 138 bp, Homo sapiens; identical to SEQ ID NO: 93662
  misc_feature 1..138: note = chr5:180531150-180531288
  misc_feature 1..138: note = Hyper
  source 1..138: mol_type = genomic DNA

SEQ ID NO: 125489 - DNA, 40 bp, Homo sapiens
  misc_feature 1..40: note = chr5:180597061-180597101
  misc_feature 1..40: note = Hyper
  source 1..40: mol_type = genomic DNA
cctgggcggaggccccgctccatcgcgcagtgccgtccac

SEQ ID NO: 125490 - DNA, 315 bp, Homo sapiens; identical to SEQ ID NO: 93665
  misc_feature 1..315: note = chr5:180601090-180601405
  misc_feature 1..315: note = Hyper
  source 1..315: mol_type = genomic DNA

SEQ ID NO: 125491 - DNA, 256 bp, Homo sapiens; identical to SEQ ID NO: 93664
  misc_feature 1..256: note = chr5:180600774-180601030
  misc_feature 1..256: note = Hyper
  source 1..256: mol_type = genomic DNA

SEQ ID NO: 125492 - DNA, 30 bp, Homo sapiens; identical to SEQ ID NO: 93666
  misc_feature 1..30: note = chr5:180631588-180631618
  misc_feature 1..30: note = Hyper
  source 1..30: mol_type = genomic DNA

SEQ ID NO: 125493 - DNA, 366 bp, Homo sapiens; identical to SEQ ID NO: 93667
  misc_feature 1..366: note = chr5:180632859-180633225
  misc_feature 1..366: note = Hyper
  source 1..366: mol_type = genomic DNA

SEQ ID NO: 125494 - DNA, 30 bp, Homo sapiens; identical to SEQ ID NO: 93668
  misc_feature 1..30: note = chr5:180644604-180644634
  misc_feature 1..30: note = Hyper
  source 1..30: mol_type = genomic DNA

SEQ ID NO: 125495 - DNA, 51 bp, Homo sapiens; identical to SEQ ID NO: 93669
  misc_feature 1..51: note = chr5:180659766-180659817
  misc_feature 1..51: note = Hypo
  source 1..51: mol_type = genomic DNA

SEQ ID NO: 125496 - DNA, 97 bp, Homo sapiens; identical to SEQ ID NO: 93670
  misc_feature 1..97: note = chr5:180661531-180661628
  misc_feature 1..97: note = Hypo
  source 1..97: mol_type = genomic DNA

SEQ ID NO: 125497 - DNA, 37 bp, Homo sapiens; identical to SEQ ID NO: 40701
  misc_feature 1..37: note = chr5:180708092-180708129
  misc_feature 1..37: note = Hypo
  source 1..37: mol_type = genomic DNA

SEQ ID NO: 125498 - DNA, 432 bp, Homo sapiens; identical to SEQ ID NO: 93672
  misc_feature 1..432: note = chr5:180708603-180709035
  misc_feature 1..432: note = Hypo
  source 1..432: mol_type = genomic DNA

SEQ ID NO: 125499 - DNA, 30 bp, Homo sapiens; identical to SEQ ID NO: 93673
  misc_feature 1..30: note = chr5:180710021-180710051
  misc_feature 1..30: note = Hypo
  source 1..30: mol_type = genomic DNA

SEQ ID NO: 125500 - DNA, 47 bp, Homo sapiens; identical to SEQ ID NO: 95468
  misc_feature 1..47: note = chr6:304250-304297
  misc_feature 1..47: note = Hypo
  source 1..47: mol_type = genomic DNA

SEQ ID NO: 125501 - DNA, 336 bp, Homo sapiens; identical to SEQ ID NO: 95524
  misc_feature 1..336: note = chr6:348707-349043
  misc_feature 1..336: note = Hypo
  source 1..336: mol_type = genomic DNA

SEQ ID NO: 125502 - DNA, 30 bp, Homo sapiens; identical to SEQ ID NO: 95583
  misc_feature 1..30: note = chr6:382294-382324
  misc_feature 1..30: note = Hypo
  source 1..30: mol_type = genomic DNA

SEQ ID NO: 125503 - DNA, 2589 bp, Homo sapiens
  misc_feature 1..2589: note = chr6:391173-393762
  misc_feature 1..2589: note = Hyper
  source 1..2589: mol_type = genomic DNA
tctttttagtgagtgcgatgttctctaaacaccgcggagaggcagggttcccggtgatggccttgccgagggtgctcccgcaacctccacctccagttctctttggaccattcctccgtcttccgttacacgctctgcaaagcgaagtccccttcgcaccagattcccgctactacacgccccccatttcccgccctggccacatcgctgcagtttagtgattgactggcctcctgaggtcctggcgcaaaggcgagattcgcatttcgcacctcgcccttcgcgggaaacggccccagtgacagtccccgaagcggcgcgcgcccggctggaggtgcgctctccgggcgcggcgcgcggagggtcgccaagggcgcgggaaccccaccccggccgcggcagcccccagccttcacgccggccctgaggctcgcccgcccggccggccccggctctcggcttgcaaagtccctctccccagtccaacccccggcccccacaggcctcggcgccccgccccgccccaggccccgccccagagagttctataaagttcctctttcccacctcgcactctcagtttcaccgctcgatcttgggacccaccgctgccctcagctccgagtccagggcgaggtaagggctggagtcgggcaggaggaggggtgtgaggctgataccagagaggacccggagcgcgaaccagaggttcgacctccagggcagcgcagggtaccccggcttcggagcgggaagggagcgcgccccgtcctggagctccgactcccaccccatctgcgctgagccggaggcgctggtttgggctccaaggcccgcctccttggctctgcccgagcctccccgcctgccctccgcgctcctgcgacggggtcgccacaagctggacgggatgagctaaccggactgtcggggccccaggagtggctgaggcggggccgtccaaggcacccacacaagacggcacaactgcctgcgagaaacaggcccggccctgtggaccccaatccgaggctccttcccctgctcttcgttcctaaggggcccaagctcacggcggcctccggcgcggtgctcacccgctggcgcaggaggaggaggagctccacatttgggtcgctccgagccttgcgtgcggtggcctagccggcctggcgcggtccctgcctcccaggctccgcagctgtcgtcgccctctcccgcgccctccccgcctccgctctcccgggcctgctccggggtccggcggacgctctgcgcgcggaatcccccgtactggggctgcagcccccgcgtctgcgccacttgtcgtttgcagagcccacttagtgcgcgctagctgggcagggataggggtcctattcggggcgaagggtctggatgcgagcagagaaagcggagggtggaggaacccggggctgcgcccctggaacgcccggccgcaggcgaggtcctccgcgcgtggaggccgccaggggagtggaaactgacagagtcgcggggaaggggcgagaagcgggttgggagtgagcgaaggcaagcgagagctgcgagtgagtgcggaaggagggccaggaggggtggcggctgggtggggagagagggtgcaagacgagcggcgcgtgtcgggagcctttgggctgcgggtgcgttacaggagagcaggcgggtaggagccttcgcgggggccgagctcggaaggcggacggctgtgcccgcccaggggatgcgcccgggccggccgcgaaggtgccttcttccgggggcccggacgaccctgacacggcacgcgcgcgcttcgcagcctcaaagactccggggcctcgtggtcactggcgcaggggatcggggcggggtgcccggagtgcggtgcctcgtggctgaagggcagctcttctccccgcagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggtctccggcctcgggagccggcgggggcgcgccggggagggcccagagacagagcccggggtccccggcgccgcctccgaggcgagcccaggggaccgcgcggggcggacgggcgggcggcggaggcatcaggtggcgtcgccggagccgcaggaggaggaaaggaggcctcggctctcagcgggaccgcgggggccgggagccgggtcctgggcgcgtggaggctgcagggaaaccgctgaaggcccggccgggcccggggaagggcggccaaaggcttgaggggttttgcgcgttcgtccgtgcgttctcgtttccacgcaagcctcccgcccttcctccgggctcccgtctgccgcctccgtccgtgggtccccctcgccctctccgtgcg

SEQ ID NO: 125504 - DNA, 125 bp, Homo sapiens; identical to SEQ ID NO: 95600
  misc_feature 1..125: note = chr6:398564-398689
  misc_feature 1..125: note = Hypo
  source 1..125: mol_type = genomic DNA

SEQ ID NO: 125505 - DNA, 169 bp, Homo sapiens; identical to SEQ ID NO: 95664
  misc_feature 1..169: note = chr6:434224-434393
  misc_feature 1..169: note = Hypo
  source 1..169: mol_type = genomic DNA

SEQ ID NO: 125506 - DNA, 244 bp, Homo sapiens; identical to SEQ ID NO: 95688
  misc_feature 1..244: note = chr6:448910-449154
  misc_feature 1..244: note = Hypo
  source 1..244: mol_type = genomic DNA

SEQ ID NO: 125507 - DNA, 30 bp, Homo sapiens; identical to SEQ ID NO: 95759
  misc_feature 1..30: note = chr6:508264-508294
  misc_feature 1..30: note = Hypo
  source 1..30: mol_type = genomic DNA

SEQ ID NO: 125508 - DNA, 30 bp, Homo sapiens; identical to SEQ ID NO: 95844
  misc_feature 1..30: note = chr6:710606-710636
  misc_feature 1..30: note = Hyper
  source 1..30: mol_type = genomic DNA

SEQ ID NO: 125509 - DNA, 257 bp, Homo sapiens; identical to SEQ ID NO: 95845
  misc_feature 1..257: note = chr6:711053-711310
  misc_feature 1..257: note = Hyper
  source 1..257: mol_type = genomic DNA

SEQ ID NO: 125510 - DNA, 28 bp, Homo sapiens
  misc_feature 1..28: note = chr6:736009-736037
  misc_feature 1..28: note = Hypo
  source 1..28: mol_type = genomic DNA
aacgtattagctggccgggcgtgatggc

SEQ ID NO: 125511 - DNA, 126 bp, Homo sapiens; identical to SEQ ID NO: 95873
  misc_feature 1..126: note = chr6:736749-736875
  misc_feature 1..126: note = Hypo
  source 1..126: mol_type = genomic DNA

SEQ ID NO: 125512 - DNA, 237 bp, Homo sapiens; identical to SEQ ID NO: 94466
  misc_feature 1..237: note = chr6:1004078-1004315
  misc_feature 1..237: note = Hypo
  source 1..237: mol_type = genomic DNA

SEQ ID NO: 125513 - DNA, 225 bp, Homo sapiens; identical to SEQ ID NO: 94700
  misc_feature 1..225: note = chr6:1271441-1271666
  misc_feature 1..225: note = Hypo
  source 1..225: mol_type = genomic DNA

SEQ ID NO: 125514 - DNA, 92 bp, Homo sapiens; identical to SEQ ID NO: 94737
  misc_feature 1..92: note = chr6:1310870-1310962
  misc_feature 1..92: note = Hyper
  source 1..92: mol_type = genomic DNA

SEQ ID NO: 125515 - DNA, 227 bp, Homo sapiens; identical to SEQ ID NO: 94738
  misc_feature 1..227: note = chr6:1311771-1311998
  misc_feature 1..227: note = Hyper
  source 1..227: mol_type = genomic DNA

SEQ ID NO: 125516 - DNA, 30 bp, Homo sapiens; identical to SEQ ID NO: 30223
  misc_feature 1..30: note = chr6:1312754-1312784
  misc_feature 1..30: note = Hyper
  source 1..30: mol_type = genomic DNA

SEQ ID NO: 125517 - DNA, 35 bp, Homo sapiens; identical to SEQ ID NO: 94742
  misc_feature 1..35: note = chr6:1313267-1313302
  misc_feature 1..35: note = Hyper
  source 1..35: mol_type = genomic DNA

SEQ ID NO: 125518 - DNA, 65 bp, Homo sapiens
  misc_feature 1..65: note = chr6:1313997-1314062
  misc_feature 1..65: note = Hyper
  source 1..65: mol_type = genomic DNA
cccggcggcggcccccgccaagccactccgaggcccggcggccggcggcgcgcacctgtactgcc

SEQ ID NO: 125519 - DNA, 40 bp, Homo sapiens; identical to SEQ ID NO: 94749
  misc_feature 1..40: note = chr6:1316770-1316810
  misc_feature 1..40: note = Hyper
  source 1..40: mol_type = genomic DNA

SEQ ID NO: 125520 - DNA, 30 bp, Homo sapiens; identical to SEQ ID NO: 94750
  misc_feature 1..30: note = chr6:1317677-1317707
  misc_feature 1..30: note = Hypo
  source 1..30: mol_type = genomic DNA

SEQ ID NO: 125521 - DNA, 1779 bp, Homo sapiens
  misc_feature 1..1779: note = chr6:1378199-1379978
  misc_feature 1..1779: note = Hyper
  source 1..1779: mol_type = genomic DNA
catattggaggaagtcggccggcagcttcaccctcctgcgggaaaatgcaaagtccatcaccaatagtcggtctaccgcagagaagtctgcaaatcccaggggcctggaactctaaaaaggccattcaagcctcaggtggactccacgtttctccatttccctgcccttccgcttttctttccttaacaagcttcttataacatttgcgtttgatgaggttcaagaggtcacttcccctccctctccgccctcctcgctcggcggagcggccgcgtccggacccctttctgaaggccgtccaagcccgcggtgcccggcggcggctgcgctgcctgaggtttcgcgcctcgcgcccggcggccgccgctgccggggccggtctcgcccacggtgaggtcagcctgcccttccctgccctgtgccgcctcgcgagtcctggagaggcccgcgccggcctcgaagcaaaagacgaccgccgaaacgcgaccgtttaccgcctgctttttccaagcaaaatttggagacaagtcccacccggggaagaacctggctaagggtcggacatggaagagaagacgctaaaacagaaattgcctccctgctttccacctgcagcttctagacgccgccctcggtgccacccctcgcggaaggcgttctcccacaccggggtcgccactgcgcccagctgcagaaagcactccgcacccccagcaattcggggcatggagccggcgggggtggcgcggccggggcctggagaagcagcgctgagtccgacaccgcccaccaggcccctcttggagaactagacaggcgacagcactcaggaccccggctgcggccggcgccgcggcagccacgcgctccagcccgcgtgcacctgcttcgctccgccgcgctcccggcttaagccggcggctccggggtcctgccccgacttttcgtactttctccctgctccgtgcctaactcaattcttaaccaaatcctgaaagcacaggagtttggttggggctgggacaggcgcagggacccaattctccccaagctctgcgggccacggccgaaaccaccccggggaaagccgtaggggcgcgccggcccacgcgggaccgagttcagaggactctgcaccgtcagtttcagggccgacgtttatagagcgcttcccacgtgccgcacgcggttctaagagcttggcttgtattaattcgtttaatcctcccagcaacactgttaggcattataatgatcccaatcgtagaagtcaaaaaaccgaggtgcagaaacaaagtaacttgttccagatcacgtaggtggtaagtgcagggtattctggagcaggagggagggtggaaagcacagaaaaaaaaaaatgaactgggaaaagcgttgacgtgcttagtatttcatactgcaggttccactttcagagccaggctgcgagcctacagggtagagtaggggtgccgggccccctggtgtcctggcgtactcggggggaagacagtcgccggccgccgggctcctgccacgctgtggcgcgcgtggaaggtgagggtcctccgctgtcccgccgcctcccacagggcggcccagagcctgcatcttttgcaaagggaacataggatggagagaaagaaagtcccgcctgaaataagcaaacgcggtggcggctttgcggtcggccacgtccgctaggaacccgcgaggcgcccttgcgagctgcgcagtcgagttttctttccactgcactttcacgttctgccggatgg

SEQ ID NO: 125522 - DNA, 785 bp, Homo sapiens; identical to SEQ ID NO: 94806
  misc_feature 1..785: note = chr6:1381866-1382651
  misc_feature 1..785: note = Hyper
  source 1..785: mol_type = genomic DNA

SEQ ID NO: 125523 - DNA, 457 bp, Homo sapiens; identical to SEQ ID NO: 94808
  misc_feature 1..457: note = chr6:1382993-1383450
  misc_feature 1..457: note = Hyper
  source 1..457: mol_type = genomic DNA

SEQ ID NO: 125524 - DNA, 979 bp, Homo sapiens
  misc_feature 1..979: note = chr6:1383677-1384656
  misc_feature 1..979: note = Hyper
  source 1..979: mol_type = genomic DNA
caaactcatctagggcgcgcccggagcttccccggcctctcttggcccatcgcgaacgagctcccctccccgactgggtcggcctcgggcgcctttcgccttcgcaggccgccggggttccgcggagggcttgtgtccctccctcccgccgccgcagcccgcccgaaggtcaggccgcatccggggcccggggcctttggccaggctgcggggaggggtggggttggggggctccccaaagcagcttctcggaggcggcgtcggggcgccctgaggtccctagtcggcctctgggcgccgagcacgttttatttatccccacagaggatgctggaggacaaaagaaatatttggacgtcagagctgatttatatttttggaagagctacgtttccttttctgaagagaagcgagcgcgccccatatcctgagctcggcggggaggacgagaggggagttttgatgcgccaggaagttcatctatcgcccaggcgctcaggacccggcgccccgccgagttcgccgccctcggaaatatttatttatttgggggaagggagggcagcggggaggagaccagccagacgggagaagaaagccctgcccgggctgggttgggacctccagggcgcttccccgcgcggccgcagccggccagcctctggtctcggttggagggcatcgcaggcgcggcctggcgacctccgggcgcctttggctggtgtcttccgtagccctcggcgcgcaccctcccgcgtgcagtgcccggagtgacctcttcaggccccgcgggcgcctcctgggtgggccccgcggcccctccaaccctgcccagcgtgtgtgcgcggcctagccatctttctccccagcctgggaaggcgggcgggaggaggggatccgaggccgggggccgcggagcaaaaggcacgcggacccctaaacgacccccgagcgttgccacagccgggagggcggaggg

SEQ ID NO: 125525 - DNA, 715 bp, Homo sapiens; identical to SEQ ID NO: 94813
  misc_feature 1..715: note = chr6:1384971-1385686
  misc_feature 1..715: note = Hyper
  source 1..715: mol_type = genomic DNA

SEQ ID NO: 125526 - DNA, 35 bp, Homo sapiens; identical to SEQ ID NO: 30237
  misc_feature 1..35: note = chr6:1386121-1386156
  misc_feature 1..35: note = Hyper
  source 1..35: mol_type = genomic DNA

SEQ ID NO: 125527 - DNA, 2570 bp, Homo sapiens
  misc_feature 1..2570: note = chr6:1389006-1391576
  misc_feature 1..2570: note = Hyper
  source 1..2570: mol_type = genomic DNA
acactaactggggtgcgggggtggggggaagaagtggaagcaaatgcaaccctaagtcccatgagatccaggtttccagagtctttgaaacttggcctaggtttctcagtgtaaatccctctgctcaaagttccgaaaacgtccacgatcgccagcggcccgcaaccctgcggcggcccccagtcgccctaacaattgtcggggagcctgcaggccctgccagaaagagagaggattggcacgttacctttgggcgtctggcaccccggcgtgtggctgagggcggcaaagtctaaacgaagttgacagatggagtcagtatcggccctggggagggcggccagggaggctccgagcagccgcacccgcagcagcaccactcggcccggcgggccaggaggaggaagggggcgcggaggggcggggctgggtcctgggatgggacgcggggcttgctgcggggggcaaacagaaagaatatttcatgaagtcagaggtggtcgagttttgcgaggggtgggggtcgtccccctggcagaaccggagtgagtctgtgatccctcaattggaaagagggtgagtgagggaaaggggaggaggccgcgagaggaatgaagagcgaggagaccctggagagcggggagcgagataagagagggaggcggccgccaggtcgggagggggaggagtgagcgcggcggcgcggagcgaggagggggcagggcggggtggggggggagggagggagggagggagcgaggagggcggccggggagggcgagggagggaggaagtccgagagacagagcgaggagcgctcctgaagggagacgtcgggctcgtccccggggtccaggccgcggtcccactcgcgggcgcagtcgcccggcgccggccgctcggccccgcggcctgggaggccgttgcgcaaggcagggcccgcggctcggggagggatgcgccgggcgttgcctcccgcccgccgccgccgccgccgccagaagccccagaggagctgagggaggcgacgccgaagcgctggcccggagtggccacggctgcagcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccccggcgcgctccaggccgccctgatgagcccgccgcccgccgccgccgccgccgccgccgccgccccggagaccacctcctcctcctcgtcgtcgtcctccgcctcctgcgcctcgtcctcgtcctcctccaattcggccagcgccccctcggctgcctgcaagagcgcgggcggcggcggcgcgggcgccgggagcgggggcgccaagaaggcgagctcggggctgcggcggcccgagaagccgccctactcgtacatcgcgctcatcgtcatggccatccagagctcgcccagcaagcgcctgacgctcagcgagatctaccagttcctgcaggcgcgcttccccttcttccgcggcgcctaccagggctggaagaactcggtgcgccacaatctctcgctcaacgagtgcttcatcaagctgcctaagggcctcgggcggcccggcaagggccactactggaccatcgacccggccagcgagttcatgttcgaggagggctcgttccgccgccggccgcgcggcttcaggcggaagtgccaggcgctcaagcccatgtaccaccgcgtggtgagcggcttgggcttcggggcgtcgctgctgccccagggcttcgacttccaggcgcccccgtcggcgccgctcggctgccacagccagggcggctacggcggcctcgacatgatgcccgcgggctacgacgccggcgcgggcgcccccagccacgcgcaccctcaccaccaccaccaccaccacgtcccgcacatgtcgcccaacccgggttccacctacatggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagagctacttgcaccagaacgctcgcgaggacctctcaggtaacgcagcacgctccagcccagccagctgggcgcaccgcttctaggcctccagggctggcggccactgccactcccacaaacagggaccccgaagctaggaggtctgagggcactgggaaaagcagatgctggggaaagccggcatcttattcgtgggagcagggatcagggtcttactgtcctcccagtatccctggccagcagccgaagcttcagaatt

SEQ ID NO: 125528 - DNA, 613 bp, Homo sapiens
  misc_feature 1..613: note = chr6:1392844-1393457
  misc_feature 1..613: note = Hyper
  source 1..613: mol_type = genomic DNA
cagccttggagaaaccgtactctaggaagaaaaaaaagcacacaggaaagagactcctgacccttcctcaaggctgctctcgccccacctcataacactgggcgcaggcacaagctcccaaaacttcggaatctggatacattactgtcttggagggggtgaaaactgcccagcaaagcaagccggcctctgtgcccctacccagcggcctcccgcggccggccttccctgggagcctcgcagaacccccgaccgagtctgggaacgcccgggggagacaatagctcgggcctgacgcccgacagggaccctctgcccttccttcctcgctgtcttgctcccgtccctataggatacccacccggccctgttgccatctccctggagcgccagcggtggaggcttcggaggagccggccggatgcaccgggaccccgcggggcctagttgggagcgcgccgcccactgaggcctgggggcccggcgaggcgcgggggtggccaaggcagtctccccggcacacagatcagcacatgtctacgcgcacacacccagcacgaccctccctcccccagcacaccccaagggccgcgccctccgctcctgggcctgg

SEQ ID NO: 125529 - DNA, 30 bp, Homo sapiens
  misc_feature 1..30: note = chr6:1393828-1393858
  misc_feature 1..30: note = Hyper
  source 1..30: mol_type = genomic DNA
attgcggggacacggcggggctgaggccac

SEQ ID NO: 125530 - DNA, 49 bp, Homo sapiens; identical to SEQ ID NO: 94891
  misc_feature 1..49: note = chr6:1515653-1515702
  misc_feature 1..49: note = Hypo
  source 1..49: mol_type = genomic DNA

SEQ ID NO: 125531 - DNA, 271 bp, Homo sapiens; identical to SEQ ID NO: 94896
  misc_feature 1..271: note = chr6:1524158-1524429
  misc_feature 1..271: note = Hyper
  source 1..271: mol_type = genomic DNA

SEQ ID NO: 125532 - DNA, 666 bp, Homo sapiens; identical to SEQ ID NO: 94982
  misc_feature 1..666: note = chr6:1604877-1605543
  misc_feature 1..666: note = Hyper
  source 1..666: mol_type = genomic DNA

SEQ ID NO: 125533 - DNA, 48 bp, Homo sapiens; identical to SEQ ID NO: 94987
  misc_feature 1..48: note = chr6:1610816-1610864
  misc_feature 1..48: note = Hyper
  source 1..48: mol_type = genomic DNA

SEQ ID NO: 125534 - DNA, 933 bp, Homo sapiens; identical to SEQ ID NO: 94988
  misc_feature 1..933: note = chr6:1611198-1612131
  misc_feature 1..933: note = Hyper
  source 1..933: mol_type = genomic DNA

SEQ ID NO: 125535 - DNA, 1036 bp, Homo sapiens
  misc_feature 1..1036: note = chr6:1614162-1615198
  misc_feature 1..1036: note = Hyper
  source 1..1036: mol_type = genomic DNA
cccctcccccagggtcgtaacctaatcgccgggaagatcgcagcggcgctggcgcgggtgtctcctcggggcaggcgggctgggggtggcctcacggccccgtttaaatctcgctgggctgtcgcggcgctaggtcccggggctgcctccagcttcctcgggttacagcctctttcggggcgggggaaggggagggggtgacggtagagactccaccgccagtctccaggagtttggtgtgatcgctccactttggggagcccggcgaggagctgggatttgcggacaaagggcccgcggccggagctggggtgtcgaggcccggaaggggagctgcagcaggtgactcacggccctgtccccacgggcgggctggcccagcccgaggcggagcagctcggccgccggagacggtaccgttctcgacgtgtccggtcggactctgtggagtagggggtggcgggtggagacccgcgcggcccacgcctggctttccggctggggcgtttctcgcaggcccggtcccttccgagtcgcgcccgccccgacgccggcctcctggacgccgctcgcgacggcaacgctctccagctaatgagctgtaattacccgcggcggcgcggggcccggcttcggtttgcgtttggagctccttcctccccacacccccctccccagattagccccggcctccgcggcctcctcctgaaattagtcgttggagaaaagcgagtcaaagggagacccctgttagtttcgctgggttcctcgcgggctgggtcggggtgccgggaagcgcgcgctgagggagggtggcaggcgcgcggtgccggggacggggacggggcggggggcgccgagccgggagaagcgccctcggggctccggccgagaagctcggaggagcccgctccctcgcccggtcaccccgcgtctccgcctggcgccgcagggccccgccgagctctcacttcctcctcgctggcctcctttgttgtgaagacgcacgtgtgtttaggagcgcagctggggtgga

SEQ ID NO: 125536 - DNA, 83 bp, Homo sapiens; identical to SEQ ID NO: 95018
  misc_feature 1..83: note = chr6:1619887-1619970
  misc_feature 1..83: note = Hyper
  source 1..83: mol_type = genomic DNA

SEQ ID NO: 125537 - DNA, 33 bp, Homo sapiens; identical to SEQ ID NO: 95030
  misc_feature 1..33: note = chr6:1625026-1625059
  misc_feature 1..33: note = Hyper
  source 1..33: mol_type = genomic DNA

SEQ ID NO: 125538 - DNA, 572 bp, Homo sapiens; identical to SEQ ID NO: 95031
  misc_feature 1..572: note = chr6:1625119-1625691
  misc_feature 1..572: note = Hyper
  source 1..572: mol_type = genomic DNA

SEQ ID NO: 125539 - DNA, 30 bp, Homo sapiens; identical to SEQ ID NO: 40708
  misc_feature 1..30: note = chr6:1637278-1637308
  misc_feature 1..30: note = Hypo
  source 1..30: mol_type = genomic DNA

SEQ ID NO: 125540 - DNA, 46 bp, Homo sapiens; identical to SEQ ID NO: 95104
  misc_feature 1..46: note = chr6:1658547-1658593
  misc_feature 1..46: note = Hypo
  source 1..46: mol_type = genomic DNA

SEQ ID NO: 125541 - DNA, 30 bp, Homo sapiens; identical to SEQ ID NO: 40709
  misc_feature 1..30: note = chr6:1708613-1708643
  misc_feature 1..30: note = Hypo
  source 1..30: mol_type = genomic DNA

SEQ ID NO: 125542 - DNA, 175 bp, Homo sapiens; identical to SEQ ID NO: 40710
  misc_feature 1..175: note = chr6:1726684-1726859
  misc_feature 1..175: note = Hypo
  source 1..175: mol_type = genomic DNA

SEQ ID NO: 125543 - DNA, 155 bp, Homo sapiens; identical to SEQ ID NO: 95277
  misc_feature 1..155: note = chr6:2244329-2244484
  misc_feature 1..155: note = Hypo
  source 1..155: mol_type = genomic DNA

SEQ ID NO: 125544 - DNA, 21 bp, Homo sapiens
  misc_feature 1..21: note = chr6:2247175-2247196
  misc_feature 1..21: note = Hypo
  source 1..21: mol_type = genomic DNA
actgagcaagccgggcgcagt

SEQ ID NO: 125545 - DNA, 30 bp, Homo sapiens; identical to SEQ ID NO: 95279
  misc_feature 1..30: note = chr6:2376070-2376100
  misc_feature 1..30: note = Hypo
  source 1..30: mol_type = genomic DNA

SEQ ID NO: 125546 - DNA, 30 bp, Homo sapiens; identical to SEQ ID NO: 95284
  misc_feature 1..30: note = chr6:2450689-2450719
  misc_feature 1..30: note = Hypo
  source 1..30: mol_type = genomic DNA

SEQ ID NO: 125547 - DNA, 30 bp, Homo sapiens; identical to SEQ ID NO: 95289
  misc_feature 1..30: note = chr6:2510157-2510187
  misc_feature 1..30: note = Hypo
  source 1..30: mol_type = genomic DNA

SEQ ID NO: 125548 - DNA, 81 bp, Homo sapiens; identical to SEQ ID NO: 95360
  misc_feature 1..81: note = chr6:2684354-2684435
  misc_feature 1..81: note = Hypo
  source 1..81: mol_type = genomic DNA

SEQ ID NO: 125549 - DNA, 68 bp, Homo sapiens; identical to SEQ ID NO: 95368
  misc_feature 1..68: note = chr6:2709559-2709627
  misc_feature 1..68: note = Hypo
  source 1..68: mol_type = genomic DNA

SEQ ID NO: 125550 - DNA, 72 bp, Homo sapiens; identical to SEQ ID NO: 40713
  misc_feature 1..72: note = chr6:2737187-2737259
  misc_feature 1..72: note = Hypo
  source 1..72: mol_type = genomic DNA

SEQ ID NO: 125551 - DNA, 510 bp, Homo sapiens; identical to SEQ ID NO: 95463
  misc_feature 1..510: note = chr6:2903047-2903557
  misc_feature 1..510: note = Hyper
  source 1..510: mol_type = genomic DNA

SEQ ID NO: 125552 - DNA, 180 bp, Homo sapiens; identical to SEQ ID NO: 95464
  misc_feature 1..180: note = chr6:2920758-2920938
  misc_feature 1..180: note = Hypo
  source 1..180: mol_type = genomic DNA

SEQ ID NO: 125553 - DNA, 30 bp, Homo sapiens; identical to SEQ ID NO: 40715
  misc_feature 1..30: note = chr6:2939086-2939116
  misc_feature 1..30: note = Hypo
  source 1..30: mol_type = genomic DNA

SEQ ID NO: 125554 - DNA, 30 bp, Homo sapiens; identical to SEQ ID NO: 95466
  misc_feature 1..30: note = chr6:2964245-2964275
  misc_feature 1..30: note = Hypo
  source 1..30: mol_type = genomic DNA

SEQ ID NO: 125555 - DNA, 68 bp, Homo sapiens; identical to SEQ ID NO: 95467
  misc_feature 1..68: note = chr6:2985307-2985375
  misc_feature 1..68: note = Hypo
  source 1..68: mol_type = genomic DNA

SEQ ID NO: 125556 - DNA, 30 bp, Homo sapiens; identical to SEQ ID NO: 95469
  misc_feature 1..30: note = chr6:3053039-3053069
  misc_feature 1..30: note = Hypo
  source 1..30: mol_type = genomic DNA

SEQ ID NO: 125557 - DNA, 104 bp, Homo sapiens; identical to SEQ ID NO: 95470
  misc_feature 1..104: note = chr6:3053334-3053438
  misc_feature 1..104: note = Hypo
  source 1..104: mol_type = genomic DNA

SEQ ID NO: 125558 - DNA, 84 bp, Homo sapiens; identical to SEQ ID NO: 95471
  misc_feature 1..84: note = chr6:3065550-3065634
  misc_feature 1..84: note = Hypo
  source 1..84: mol_type = genomic DNA

SEQ ID NO: 125559 - DNA, 94 bp, Homo sapiens; identical to SEQ ID NO: 40718
  misc_feature 1..94: note = chr6:3104457-3104551
  misc_feature 1..94: note = Hypo
  source 1..94: mol_type = genomic DNA

SEQ ID NO: 125560 - DNA, 35 bp, Homo sapiens; identical to SEQ ID NO: 40719
  misc_feature 1..35: note = chr6:3225962-3225997
  misc_feature 1..35: note = Hypo
  source 1..35: mol_type = genomic DNA

SEQ ID NO: 125561 - DNA, 50 bp, Homo sapiens; identical to SEQ ID NO: 95474
  misc_feature 1..50: note = chr6:3227693-3227743
  misc_feature 1..50: note = Hyper
  source 1..50: mol_type = genomic DNA

SEQ ID NO: 125562 - DNA, 494 bp, Homo sapiens; identical to SEQ ID NO: 95475
  misc_feature 1..494: note = chr6:3228186-3228680
  misc_feature 1..494: note = Hyper
  source 1..494: mol_type = genomic DNA

SEQ ID NO: 125563 - DNA, 326 bp, Homo sapiens; identical to SEQ ID NO: 95476
  misc_feature 1..326: note = chr6:3228921-3229247
  misc_feature 1..326: note = Hyper
  source 1..326: mol_type = genomic DNA

SEQ ID NO: 125564 - DNA, 325 bp, Homo sapiens; identical to SEQ ID NO: 95477
  misc_feature 1..325: note = chr6:3229307-3229632
  misc_feature 1..325: note = Hyper
  source 1..325: mol_type = genomic DNA

SEQ ID NO: 125565 - DNA, 358 bp, Homo sapiens; identical to SEQ ID NO: 30253
  misc_feature 1..358: note = chr6:3231580-3231938
  misc_feature 1..358: note = Hyper
  source 1..358: mol_type = genomic DNA

SEQ ID NO: 125566 - DNA, 396 bp, Homo sapiens; identical to SEQ ID NO: 95480
  misc_feature 1..396: note = chr6:3285139-3285535
  misc_feature 1..396: note = Hypo
  source 1..396: mol_type = genomic DNA

SEQ ID NO: 125567 - DNA, 48 bp, Homo sapiens; identical to SEQ ID NO: 95481
  misc_feature 1..48: note = chr6:3286048-3286096
  misc_feature 1..48: note = Hypo
  source 1..48: mol_type = genomic DNA

SEQ ID NO: 125568 - DNA, 30 bp, Homo sapiens; identical to SEQ ID NO: 40721
  misc_feature 1..30: note = chr6:3298330-3298360
  misc_feature 1..30: note = Hypo
  source 1..30: mol_type = genomic DNA

SEQ ID NO: 125569 - DNA, 297 bp, Homo sapiens; identical to SEQ ID NO: 95483
  misc_feature 1..297: note = chr6:3307198-3307495
  misc_feature 1..297: note = Hypo
  source 1..297: mol_type = genomic DNA

SEQ ID NO: 125570 - DNA, 149 bp, Homo sapiens; identical to SEQ ID NO: 95484
  misc_feature 1..149: note = chr6:3328274-3328423
  misc_feature 1..149: note = Hypo
  source 1..149: mol_type = genomic DNA

SEQ ID NO: 125571 - DNA, 52 bp, Homo sapiens; identical to SEQ ID NO: 95485
  misc_feature 1..52: note = chr6:3333103-3333155
  misc_feature 1..52: note = Hypo
  source 1..52: mol_type = genomic DNA

SEQ ID NO: 125572 - DNA, 128 bp, Homo sapiens; identical to SEQ ID NO: 95488
  misc_feature 1..128: note = chr6:3361088-3361216
  misc_feature 1..128: note = Hypo
  source 1..128: mol_type = genomic DNA

SEQ ID NO: 125573 - DNA, 197 bp, Homo sapiens; identical to SEQ ID NO: 40724
  misc_feature 1..197: note = chr6:3363773-3363970
  misc_feature 1..197: note = Hypo
  source 1..197: mol_type = genomic DNA

SEQ ID NO: 125574 - DNA, 30 bp, Homo sapiens; identical to SEQ ID NO: 95501
  misc_feature 1..30: note = chr6:3405673-3405703
  misc_feature 1..30: note = Hypo
  source 1..30: mol_type = genomic DNA

SEQ ID NO: 125575 - DNA, 30 bp, Homo sapiens; identical to SEQ ID NO: 95508
  misc_feature 1..30: note = chr6:3438520-3438550
  misc_feature 1..30: note = Hypo
  source 1..30: mol_type = genomic DNA

SEQ ID NO: 125576 - DNA, 30 bp, Homo sapiens; identical to SEQ ID NO: 95520
  misc_feature 1..30: note = chr6:3471840-3471870
  misc_feature 1..30: note = Hypo
  source 1..30: mol_type = genomic DNA

SEQ ID NO: 125577 - DNA, 30 bp, Homo sapiens; identical to SEQ ID NO: 95535
  misc_feature 1..30: note = chr6:3569703-3569733
  misc_feature 1..30: note = Hypo
  source 1..30: mol_type = genomic DNA

SEQ ID NO: 125578 - DNA, 79 bp, Homo sapiens; identical to SEQ ID NO: 95539
  misc_feature 1..79: note = chr6:3593615-3593694
  misc_feature 1..79: note = Hypo
  source 1..79: mol_type = genomic DNA

SEQ ID NO: 125579 - DNA, 132 bp, Homo sapiens; identical to SEQ ID NO: 95568
  misc_feature 1..132: note = chr6:3751602-3751734
  misc_feature 1..132: note = Hyper
  source 1..132: mol_type = genomic DNA

SEQ ID NO: 125580 - DNA, 32 bp, Homo sapiens; identical to SEQ ID NO: 95570
  misc_feature 1..32: note = chr6:3752663-3752695
  misc_feature 1..32: note = Hyper
  source 1..32: mol_type = genomic DNA

SEQ ID NO: 125581 - DNA, 153 bp, Homo sapiens; identical to SEQ ID NO: 95585
  misc_feature 1..153: note = chr6:3881645-3881798
  misc_feature 1..153: note = Hypo
  source 1..153: mol_type = genomic DNA

SEQ ID NO: 125582 - DNA, 33 bp, Homo sapiens; identical to SEQ ID NO: 95602
  misc_feature 1..33: note = chr6:4020063-4020096
  misc_feature 1..33: note = Hypo
  source 1..33: mol_type = genomic DNA

SEQ ID NO: 125583 - DNA, 33 bp, Homo sapiens; identical to SEQ ID NO: 95603
  misc_feature 1..33: note = chr6:4020336-4020369
  misc_feature 1..33: note = Hypo
  source 1..33: mol_type = genomic DNA

SEQ ID NO: 125584 - DNA, 145 bp, Homo sapiens; identical to SEQ ID NO: 95617
  misc_feature 1..145: note = chr6:4135160-4135305
  misc_feature 1..145: note = Hyper
  source 1..145: mol_type = genomic DNA

SEQ ID NO: 125585 - DNA, 35 bp, Homo sapiens; identical to SEQ ID NO: 95640
  misc_feature 1..35: note = chr6:4276412-4276447
  misc_feature 1..35: note = Hypo
  source 1..35: mol_type = genomic DNA

SEQ ID NO: 125586 - DNA, 22 bp, Homo sapiens
  misc_feature 1..22: note = chr6:4334950-4334972
  misc_feature 1..22: note = Hypo
  source 1..22: mol_type = genomic DNA
gtagacccgagctgttcctatt

SEQ ID NO: 125587 - DNA, 36 bp, Homo sapiens; identical to SEQ ID NO: 95700
  misc_feature 1..36: note = chr6:4647938-4647974
  misc_feature 1..36: note = Hyper
  source 1..36: mol_type = genomic DNA

SEQ ID NO: 125588 - DNA, 389 bp, Homo sapiens; identical to SEQ ID NO: 95705
  misc_feature 1..389: note = chr6:4775154-4775543
  misc_feature 1..389: note = Hyper
  source 1..389: mol_type = genomic DNA

SEQ ID NO: 125589 - DNA, 186 bp, Homo sapiens; identical to SEQ ID NO: 95707
  misc_feature 1..186: note = chr6:4804538-4804724
  misc_feature 1..186: note = Hypo
  source 1..186: mol_type = genomic DNA

SEQ ID NO: 125590 - DNA, 33 bp, Homo sapiens; identical to SEQ ID NO: 95708
  misc_feature 1..33: note = chr6:4836425-4836458
  misc_feature 1..33: note = Hypo
  source 1..33: mol_type = genomic DNA

SEQ ID NO: 125591 - DNA, 273 bp, Homo sapiens; identical to SEQ ID NO: 95709
  misc_feature 1..273: note = chr6:4853849-4854122
  misc_feature 1..273: note = Hypo
  source 1..273: mol_type = genomic DNA

SEQ ID NO: 125592 - DNA, 30 bp, Homo sapiens; identical to SEQ ID NO: 95710
  misc_feature 1..30: note = chr6:4858773-4858803
  misc_feature 1..30: note = Hypo
  source 1..30: mol_type = genomic DNA

SEQ ID NO: 125593 - DNA, 65 bp, Homo sapiens; identical to SEQ ID NO: 95711
  misc_feature 1..65: note = chr6:4874127-4874192
  misc_feature 1..65: note = Hypo
  source 1..65: mol_type = genomic DNA

SEQ ID NO: 125594 - DNA, 83 bp, Homo sapiens; identical to SEQ ID NO: 95714
  misc_feature 1..83: note = chr6:4910864-4910947
  misc_feature 1..83: note = Hypo
  source 1..83: mol_type = genomic DNA

SEQ ID NO: 125595 - DNA, 33 bp, Homo sapiens; identical to SEQ ID NO: 40728
  misc_feature 1..33: note = chr6:4920708-4920741
  misc_feature 1..33: note = Hypo
  source 1..33: mol_type = genomic DNA

SEQ ID NO: 125596 - DNA, 101 bp, Homo sapiens; identical to SEQ ID NO: 95716
  misc_feature 1..101: note = chr6:4931677-4931778
  misc_feature 1..101: note = Hypo
  source 1..101: mol_type = genomic DNA

SEQ ID NO: 125597 - DNA, 275 bp, Homo sapiens; identical to SEQ ID NO: 95718
  misc_feature 1..275: note = chr6:4951177-4951452
  misc_feature 1..275: note = Hypo
  source 1..275: mol_type = genomic DNA

SEQ ID NO: 125598 - DNA, 197 bp, Homo sapiens; identical to SEQ ID NO: 95724
  misc_feature 1..197: note = chr6:5026576-5026773
  misc_feature 1..197: note = Hyper
  source 1..197: mol_type = genomic DNA

SEQ ID NO: 125599 - DNA, 30 bp, Homo sapiens; identical to SEQ ID NO: 95760
  misc_feature 1..30: note = chr6:5084912-5084942
  misc_feature 1..30: note = Hyper
  source 1..30: mol_type = genomic DNA

SEQ ID NO: 125600 - DNA, 908 bp, Homo sapiens
  misc_feature 1..908: note = chr6:5085637-5086545
  misc_feature 1..908: note = Hyper
  source 1..908: mol_type = genomic DNA
gctccttccacggcccgaggagttagttaagtctccagaggggcccggttcggcccgagcaagtccaggggcgaacggcgtcatggagcccataggggcgcggctaagtttggaggcgccgggaccagcgcccttccgagaggccccgccggccgaggagctgcccgccccggtggtcccctgtgtgcagggtggcggcgacggcggtggcgcttcggagaccccgagtcctgacgctcagctaggggataggcccctgtccccgaaggaagaggccgccccccaggagcaggaggagctgctggaatgccgccgccgctgccgcgcgcgctccttttccttgcccgccgaccccatcttgcaggcggccaagttcctgcagcagcagcagcaacaggcggtggcactgggcggcgagggggcggaggacgcacagctcggcccgggcggctgctgcgccaagtgcaagaagcgggtgcagttcgcggacacgctggggctaagcctggccagcgtgaagcacttcagcgaggcggaggagccgcaggtgccgcccgccgtgctctcgcgcctgcgaagcttccctatgcgtgccgaggacctggagcagctcggggggctgctggccgcggcggcagtggccgcgcccctttcagcgccgccttcccggctccggccgctcttccagctcccggggccgagcgccgcggccgagcgtctgcagcggcagcgcgtgtgcctggagcgcgtgcagtgctcgacggcctcgggcgctgaggtgaagggctccggccgggtgctcagctgccctgggcccagggccgtgaccgtgcgctacacctttaccgagtggcgctccttcctggacgtgccggctgagctgcagcccgagccgctggagccacagc

SEQ ID NO: 125601 - DNA, 85 bp, Homo sapiens; identical to SEQ ID NO: 95787
  misc_feature 1..85: note = chr6:5783294-5783379
  misc_feature 1..85: note = Hypo
  source 1..85: mol_type = genomic DNA

SEQ ID NO: 125602 - DNA, 377 bp, Homo sapiens
  misc_feature 1..377: note = chr6:5851459-5851836
  misc_feature 1..377: note = Hyper
  source 1..377: mol_type = genomic DNA
cgctgcacctcggggcgtgttctcccacccatctgtgctcaggcatcccttccctctcctctggattttgtttaggcctatttgcaatttcttaaaaaaaaaaaaaaatctaataaatagttggagcctgaaagagagctggccaatgaaacgccgcgttggggcattaccgcatcggtgaggccgcccattggctggcgtgccctgaggcgatggctgcgtttccccggcaccgccccgcgccggtgcccacgcgtcccgggcttcaggggagcacctgggaagcgctgggggtcgcgtgcccttggccggaggcctggtcacccgcaggccctgccatcctcggcttggccgctgctgcccgcgcgcctgtggcg

SEQ ID NO: 125603 - DNA, 181 bp, Homo sapiens; identical to SEQ ID NO: 40731
  misc_feature 1..181: note = chr6:5892797-5892978
  misc_feature 1..181: note = Hypo
  source 1..181: mol_type = genomic DNA

SEQ ID NO: 125604 - DNA, 1253 bp, Homo sapiens; identical to SEQ ID NO: 95801
  misc_feature 1..1253: note = chr6:5996021-5997274
  misc_feature 1..1253: note = Hyper
  source 1..1253: mol_type = genomic DNA

SEQ ID NO: 125605 - DNA, 386 bp, Homo sapiens; identical to SEQ ID NO: 95802
  misc_feature 1..386: note = chr6:5997513-5997899
  misc_feature 1..386: note = Hyper
  source 1..386: mol_type = genomic DNA

SEQ ID NO: 125606 - DNA, 2081 bp, Homo sapiens
  misc_feature 1..2081: note = chr6:6003269-6005350
  misc_feature 1..2081: note = Hyper
  source 1..2081: mol_type = genomic DNA
aagcctcaggcttggcgctctgtccttggtgggcgctcagcaaacactgctgaatgaatgaacgaatatagtccctggaagccaccagcagttaccgaaatggattgtttcattataaaaccgattgcctaccgtggactctgtattccgagtgagaccctcggatgcaccctctcccgccccgctggaaagagggcagcctggacgtcctgagacctggcgcggatgatgagtggtctggagaggagaaggccagaggccgggcggggtcacggatgagtctgcctgggtcacctccgcaaaggccaaatccacgaacctcgggcctctttctctcctcctcccctgtccgccactcggctccccagacacccttaacaacccacccgcccgccaaaaagcccgcctacactccggacggcagcggggagaggctgttcttctccaggtgccagccctgctgctgaaagtgagctcgccgcggcccggggctcctggccccagctcaggactccctgcagagagcaggcagggataaaagctgagcggcgggaggaggaggaggaggaggaaacacaggccgcacgaaggtccaagccccaagcccccaagcccccggcctctggacggccaaaccccgaggcgcgggactggaaggacaggtaccaggctgcgggcgcgcggctgtggccatctctttccgccctgaggccgacgaacccggctggaagctgagtgcctagcggcccaaagcagcccgggcgccgggagggcgccagagaagcacagcgttagggcggggaagaaagggtgaatctcagaatcgaaatccgcactggcgcccacgaccctgggcgccggcctggtcctcggcagctttctggcggctgcgcttgtgtgtgaatgtgtcccgggaggaccggacacctcaatcccccggcccccaacgcgggcgcctgtccgcgagcgccgggccagacgccgaagaggaaggtgaccgaacccgtagcagcttccgagagcgtacccgtttgcaaattgctgcaggaagagcgaggcgggccttgcgctttttaatccggaacgggaagcactggggaagggaccgaggttaacttcgacctccgctggggcagatacgtaaaccttctcaaacctccgagttcaccttacagcgaacattaaatacccttgcgactacaatactaacaaatcgaacactgacgtaaaatcttaagaataaacgaatctttgttctgatagagctcgttcaaaatggaaatacactccacacatcttcctctataacgcatgtcacaaatacagctttgcagagaagaaacgaaataaaataaagtccaatctccccgtccacgtctctccccaccccttgcctacacccccaaaactcagtggcgaaagaagcccctaaaatgcattgacattttttaaggggaattggggctcgccgggggcgggagcgctcttgtcacgttatcttcccaggcgctgctggagaagaccctgcacaccgcgcatgtgtgagtgtgtgctgtgtaaaataagtcgtgaacatttctgtcttttaaaactgtgactccttggactctagccttctctgggaggccgggaggctgcgcgcgggacggattttgcaggcgcacgcgtcccagcaggtcgcagcccgtgggtccctcgctgtccttcctgaaccccgcttaggcgagactctagcgggtgaccctggctccttccctgtcctctctgccgtccccttcttgtgcggtttccatccgttcattcattcgttcgacctctcattcattccgaacttcctcctgctgcgtcttctttcgtgttcaccacactcttctacctccccgcccctcccaacccccacttttcttgccaaatgtcaatgatttgggacagctcccagccgtgaattaataaagaccgaggttctgttgcaggaaagggcagacattagggaacaaatacgttcaatttcaattccacagtcaacaaatagtcatttttggaccgaggttaatgtgttcaaaacgcgtccctcaggcacg

SEQ ID NO: 125607 - DNA, 129 bp, Homo sapiens; identical to SEQ ID NO: 95806
  misc_feature 1..129: note = chr6:6006283-6006412
  misc_feature 1..129: note = Hyper
  source 1..129: mol_type = genomic DNA

SEQ ID NO: 125608 - DNA, 1098 bp, Homo sapiens
  misc_feature 1..1098: note = chr6:6006674-6007772
  misc_feature 1..1098: note = Hyper
  source 1..1098: mol_type = genomic DNA
aagggggaaaaaaaccgtgtccagaaaatgtccggccgcacacatttcctggcgaacatttggaatctatagctttaggaaaaaccgatctgggacgcgctagtccccaggaactgatgcccccaccctcgggggattgccggcttctccgcaccctggggcggccgcggacccgctagtccccctccgcgcctcgggccggggcaggctgcctcccgcctccagcctccagccgggctgagcggccacttacctatttgcaccgcgaggatcagtgaaatatatctgccgttcaacttaagtcccatcctacgtttagtcaaaccatttgcgaccgcagacctttaaatagttagtttagagaacgcgggggaaagccaaaaaataggcattgccaacaagttccgggagcgacagagactttatgcactgggaaggcagagggaggagagaaagagagggagcgaggaagagacagaaagagagagagagagagaaagagagagagagagagaggctgaggggggggggagagctgggaatggttcactccattagaagggggcggaggaagtacagcctcacgcccacgagcaggcctgacgtgggggatgacacggaatgattttttttttaatatagacaccttggtagagaatcgccatttatagtcatcagaagctggaattaatcagatatctccaattaatgtgcgatctgaacgaaattttgcctcccgggggtgagcactttcctattctagcggtcacccctgcctcttcctcgttccgggggccccccagccccgccgcctccctgcgcagaacaggggctccccctcccttccccgccaggagctggggagtcctggcgcgcccactcgattgtttcaacctgctccccctcctccatcagcaccacagagaatccagcccgctctctacgatgcaggggggtttaaaggagcgggagagggaaaaacagctaagctagctcgattaattcgaaagcgctcctcggccgcccgccccctgcgcttgcctaccctctttttctccaacccagcagctgagctctgggcgcagcctggagcgcgtg

SEQ ID NO: 125609 - DNA, 617 bp, Homo sapiens; identical to SEQ ID NO: 95809
  misc_feature 1..617: note = chr6:6007832-6008449
  misc_feature 1..617: note = Hyper
  source 1..617: mol_type = genomic DNA

SEQ ID NO: 125610 - DNA, 863 bp, Homo sapiens; identical to SEQ ID NO: 95810
  misc_feature 1..863: note = chr6:6008689-6009552
  misc_feature 1..863: note = Hyper
  source 1..863: mol_type = genomic DNA

SEQ ID NO: 125611 - DNA, 30 bp, Homo sapiens; identical to SEQ ID NO: 14827
  misc_feature 1..30: note = chr6:6045657-6045687
  misc_feature 1..30: note = Hypo
  source 1..30: mol_type = genomic DNA

SEQ ID NO: 125612 - DNA, 30 bp, Homo sapiens; identical to SEQ ID NO: 40733
  misc_feature 1..30: note = chr6:6055082-6055112
  misc_feature 1..30: note = Hypo
  source 1..30: mol_type = genomic DNA

SEQ ID NO: 125613 - DNA, 40 bp, Homo sapiens; identical to SEQ ID NO: 95813
  misc_feature 1..40: note = chr6:6058547-6058587
  misc_feature 1..40: note = Hypo
  source 1..40: mol_type = genomic DNA

SEQ ID NO: 125614 - DNA, 216 bp, Homo sapiens; identical to SEQ ID NO: 95814
  misc_feature 1..216: note = chr6:6180497-6180713
  misc_feature 1..216: note = Hypo
  source 1..216: mol_type = genomic DNA

SEQ ID NO: 125615 - DNA, 30 bp, Homo sapiens; identical to SEQ ID NO: 95815
  misc_feature 1..30: note = chr6:6199350-6199380
  misc_feature 1..30: note = Hypo
  source 1..30: mol_type = genomic DNA

SEQ ID NO: 125616 - DNA, 37 bp, Homo sapiens; identical to SEQ ID NO: 14828
  misc_feature 1..37: note = chr6:6367079-6367116
  misc_feature 1..37: note = Hypo
  source 1..37: mol_type = genomic DNA

SEQ ID NO: 125617 - DNA, 180 bp, Homo sapiens; identical to SEQ ID NO: 95828
  misc_feature 1..180: note = chr6:6534755-6534935
  misc_feature 1..180: note = Hypo
  source 1..180: mol_type = genomic DNA

SEQ ID NO: 125618 - DNA, 702 bp, Homo sapiens; identical to SEQ ID NO: 95829
  misc_feature 1..702: note = chr6:6546520-6547222
  misc_feature 1..702: note = Hyper
  source 1..702: mol_type = genomic DNA

SEQ ID NO: 125619 - DNA, 71 bp, Homo sapiens; identical to SEQ ID NO: 95830
  misc_feature 1..71: note = chr6:6720969-6721040
  misc_feature 1..71: note = Hypo
  source 1..71: mol_type = genomic DNA

SEQ ID NO: 125620 - DNA, 30 bp, Homo sapiens; identical to SEQ ID NO: 95831
  misc_feature 1..30: note = chr6:6745438-6745468
  misc_feature 1..30: note = Hypo
  source 1..30: mol_type = genomic DNA

SEQ ID NO: 125621 - DNA, 198 bp, Homo sapiens; identical to SEQ ID NO: 40736
  misc_feature 1..198: note = chr6:6891420-6891618
  misc_feature 1..198: note = Hypo
  source 1..198: mol_type = genomic DNA

SEQ ID NO: 125622 - DNA, 30 bp, Homo sapiens; identical to SEQ ID NO: 95833
  misc_feature 1..30: note = chr6:6921408-6921438
  misc_feature 1..30: note = Hypo
  source 1..30: mol_type = genomic DNA

SEQ ID NO: 125623 - DNA, 219 bp, Homo sapiens
  misc_feature 1..219: note = chr6:7051702-7051921
  misc_feature 1..219: note = Hyper
  source 1..219: mol_type = genomic DNA
agggcagcagccctgcggcggctcgggaagaacaacttgtgcgaactgggccgcgcttcccccgggcgctgcatccgccttccgagatgctggcagcccgggacggcctagcgcggccctctccttatttatccaccgagcacagtttccatggttccgccgccatccttccgcccccttcctcgcgcggagcccagcggcagtcgagggcctggctgg

SEQ ID NO: 125624 - DNA, 84 bp, Homo sapiens; identical to SEQ ID NO: 95846
  misc_feature 1..84: note = chr6:7120320-7120404
  misc_feature 1..84: note = Hypo
  source 1..84: mol_type = genomic DNA

SEQ ID NO: 125625 - DNA, 30 bp, Homo sapiens; identical to SEQ ID NO: 40737
  misc_feature 1..30: note = chr6:7132823-7132853
  misc_feature 1..30: note = Hypo
  source 1..30: mol_type = genomic DNA

SEQ ID NO: 125626 - DNA, 184 bp, Homo sapiens; identical to SEQ ID NO: 95855
  misc_feature 1..184: note = chr6:7204204-7204388
  misc_feature 1..184: note = Hypo
  source 1..184: mol_type = genomic DNA

SEQ ID NO: 125627 - DNA, 30 bp, Homo sapiens; identical to SEQ ID NO: 95856
  misc_feature 1..30: note = chr6:7204910-7204940
  misc_feature 1..30: note = Hypo
  source 1..30: mol_type = genomic DNA

SEQ ID NO: 125628 - DNA, 27 bp, Homo sapiens
  misc_feature 1..27: note = chr6:7237769-7237796
  misc_feature 1..27: note = Hypo
  source 1..27: mol_type = genomic DNA
tttaagcgctcgcgttggggcttgcag

SEQ ID NO: 125629 - DNA, 38 bp, Homo sapiens; identical to SEQ ID NO: 95864
  misc_feature 1..38: note = chr6:7279451-7279489
  misc_feature 1..38: note = Hypo
  source 1..38: mol_type = genomic DNA

SEQ ID NO: 125630 - DNA, 87 bp, Homo sapiens; identical to SEQ ID NO: 95887
  misc_feature 1..87: note = chr6:7543263-7543350
  misc_feature 1..87: note = Hyper
  source 1..87: mol_type = genomic DNA

SEQ ID NO: 125631 - DNA, 30 bp, Homo sapiens; identical to SEQ ID NO: 95888
  misc_feature 1..30: note = chr6:7562793-7562823
  misc_feature 1..30: note = Hypo
  source 1..30: mol_type = genomic DNA

SEQ ID NO: 125632 - DNA, 2866 bp, Homo sapiens
  misc_feature 1..2866: note = chr6:7726255-7729121
  misc_feature 1..2866: note = Hyper
  source 1..2866: mol_type = genomic DNA
tggctgccagcctgtcggttaccgcggggcggggagtcccggggctggagtgaggtacctgagccgggcgcgcagcagaaagcccacgttggccgctgcggggagcgcggcgtggagaggcgggagaccgaattccggcgccgccgccgcggccgctgctcggtgcactagcccccttccttcccatcctttctgcgagcgggtttgctgggcagccgggcgaccgccgaacggaaagcaagatcctcgccgcctccgcttgaggaggcgtgcggcgcgcggagattttgagtgggagcgacggtgcccgagagctcaggggcgcggagttcgtgagcgagaaggaagttaaacctcgcggaatagactggcatttcgggacgccttgtcgccgcagcctgggccctgcaacggggtaaacttcatggtggccctgcgatctggggaggggcgtgcgccacggtgatgccgggcatctcccgcagctcgtgagcggccccgctccccgctgccccgggtcccactcagtcgccagggagagcgcggggcagcgcacgtgtgcggccagcgaggcccagagtgaccgcgccgcgactcgcaggagccagggcgcaggctgcagtgcagcccggactcagacgcacctggcctggaccgcgcgcctctagagacctgcgcgaggctgtgaggctccccttcctcccctccaagcggttctcctggtgatcgccccttcgccacctctctagcctgggcaactgggggcgccccggacgaccatgagagataaggactgagggccaggaaggggaagcgagcccgccgagaggtggcggggactgctcacgccaagggccacagcggccgcgctccggcctcgctccgccgctccacgcctcgcgggatccgcgggggcagcccggccgggcggggatgccggggctggggcggagggcgcagtggctgtgctggtggtgggggctgctgtgcagctgctgcgggcccccgccgctgcggccgcccttgcccgctgccgcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcagcggcggcgcgtccccactgaccagcgcgcaggacagcgccttcctcaacgacgcggacatggtcatgagctttgtgaacctgggtaaggatttggggtaacgtaatgacgagaacatttcccccttttcagtgtcccgggcccaggggatggagtgagggggtggaggagctcccggcgcgcgggtcccgcctggtgcgccagagaacgcggggacaggcaggctgtgctcccgccacctgcgcggcggtgggcggcacatgcgctcccccgcgccgcgggcagggctgcgcgccgaggcccccagaggcggctggccggccgggccgcggggctccgggagcgctgtccccagcgggcgtgtatttgcggactccctgagcacgttccgcgctttttttcacttctgcccagctctggccaggttaactcaactgcagcaggagagtccagcccgagtgtggccatcctgggaagagggctcttcagtacgattttcccctctaaactgccgccttttgccccctaacttggagtgcagttttcccaccgagacttttagggaatccgacagcggctgggaactttgaaaacttggcatgagtatgtttagaggtatccacggcactaggggaggttgcagagggaagtcccaaaaggaccgcggaaggcgctcggatcccggccgggcggggctcgcttctgtttggggcgggatgaaagctcaactggggtaatccatcctgtgccccggctcacatgcccttggccattgtccccaaaggctgaacctttgatcaatgcagcccaagctgcacgggcagagaaagggtgcggggtaggggccggggttgggcgctgagctcctctgaaccggttgccaggcaacagaatggaaattcacgggcggctaaatggagctccgccacaaatgttctgtggcaaacccggacccagtcacatcgccctttctcccccctcccaccccactgagttttctcatctgtaaatgagaagggtgcagagaagactcttttcttcggagtcagtgcctccggtttgcactgcttttcattcataagctgacttagtttagcgcagacataggatggagggacgcgctgtcagcggacagatcatgggtgcactggctacgcccgggatggttgcagctgcgcggcggggtggggcttcacgggcctccttcccatgtgagacggtggttgtgcccaggccctgaagtgggtgagcagacactcgccaaaggagcacacgggtctcccagccacgtcaaagacgctcatcttttaacggcattacttactggaatgattcccgcgtagactatctggg

SEQ ID NO: 125633 - DNA, 183 bp, Homo sapiens; identical to SEQ ID NO: 95899
  misc_feature 1..183: note = chr6:7764169-7764352
  misc_feature 1..183: note = Hypo
  source 1..183: mol_type = genomic DNA

SEQ ID NO: 125634 - DNA, 30 bp, Homo sapiens; identical to SEQ ID NO: 95908
  misc_feature 1..30: note = chr6:7844836-7844866
  misc_feature 1..30: note = Hypo
  source 1..30: mol_type = genomic DNA

SEQ ID NO: 125635 - DNA, 362 bp, Homo sapiens; identical to SEQ ID NO: 95909
  misc_feature 1..362: note = chr6:7911626-7911988
  misc_feature 1..362: note = Hypo
  source 1..362: mol_type = genomic DNA

SEQ ID NO: 125636 - DNA, 39 bp, Homo sapiens; identical to SEQ ID NO: 95910
  misc_feature 1..39: note = chr6:7920126-7920165
  misc_feature 1..39: note = Hypo
  source 1..39: mol_type = genomic DNA

SEQ ID NO: 125637 - DNA, 195 bp, Homo sapiens
  misc_feature 1..195: note = chr6:10113557-10113752
  misc_feature 1..195: note = Hyper
  source 1..195: mol_type = genomic DNA
tgagccgctgataaccggccgactggggagcccgggagcccttgcggaggcgtgggctggctcgggtgcgcaggcctggcccagcgggggcgccgggagagccggcccaattatgatgttgggagggatgttgtgatcctcggaggcggctctcgctaacaggcaggggcctgggggtcccgaggcaaggccggt

SEQ ID NO: 125638 - DNA, 860 bp, Homo sapiens
  misc_feature 1..860: note = chr6:10381507-10382367
  misc_feature 1..860: note = Hyper
  source 1..860: mol_type = genomic DNA
ggatgaaaggagagccgtccacccagcgaggggcttgtgtgccctagagggcgctgggccccgcgcgctttcctggctgtccccgccggctttccaccctccccaaagcccaggtgcccaccgtgggtcgctgcggcctttccccttcttggccaaatccgattacttcgcagcctgcagatggcatcgccggctaagggcagcctgcggcaggtccccgagcctgagcactcctcctatctggggcctgagaggacgctctgggctttttcccaggcccagggtgcgcggcctgctagcgcctttcgaggcacagtcccaagataggctcttgtccttcgacgcccccttggcacaagcgcactggcgccctccgctcaacccaccttgcctttggggcgggcttcaaccctgggaagacaggcctgggggaagcgagaggagaggcccgaatagaggttccggctcaatctttcccagacggaggcctggtgtttccagctcagttgcatcttccagccgcgggctcctggcccaaacagaatgtgtttgctttcacaccgggacggcaagcggagtccgcctcagtgagcagcgagctgcgcagtccggacgggtgtcgcccccagagactcgccagccgcccccagacactcgccagccgtccccatctctaatccaccgtccaggcccgggccctgggaagaccccggggacgcgctggagcccctgaagggggtcagggggaacaatgcccgaaaagggagcctccccgaccgccagtccaaaggaaccggggatgtggcagcgattgcgaggggcctaggttagggacacgctcttctcgctgggtcccaagc

SEQ ID NO: 125639 - DNA, 389 bp, Homo sapiens; identical to SEQ ID NO: 94494
  misc_feature 1..389: note = chr6:10382722-10383111
  misc_feature 1..389: note = Hyper
  source 1..389: mol_type = genomic DNA

SEQ ID NO: 125640 - DNA, 347 bp, Homo sapiens; identical to SEQ ID NO: 94495
  misc_feature 1..347: note = chr6:10383727-10384074
  misc_feature 1..347: note = Hyper
  source 1..347: mol_type = genomic DNA

SEQ ID NO: 125641 - DNA, 75 bp, Homo sapiens; identical to SEQ ID NO: 94496
  misc_feature 1..75: note = chr6:10384438-10384513
  misc_feature 1..75: note = Hyper
  source 1..75: mol_type = genomic DNA

SEQ ID NO: 125642 - DNA, 1452 bp, Homo sapiens
  misc_feature 1..1452: note = chr6:10384821-10386273
  misc_feature 1..1452: note = Hyper
  source 1..1452: mol_type = genomic DNA
tgcttctgcatattgcgttggtcgtggttttgtttaaaaagacgtaagaagggaagagaaagactgagatgatggggagatggtatttgcttgtttcatcttttatttttaaaagtaaatagggaagggggaaggagggggagccgtggcgggcgctacgtctgcgagctgattactccccgtctgaaagcggctccatttcccgcacggtgggtaagtcctttatcgggggaagccccggcctcgcccgcagccattcctcgcctcgaggcgcgcgccgggccggggcgcgggagccgctccgcgactccgtaatgacccgggttcgccgcagctgcgccctgaccctttgtgatggcgccgatagcgctcggatgaaattatgtccttctccgggtgtgaaattaccatgtttattaattgagccagacattagctttaccttttctttttaagccgtgaaaatttgcgattcagggcaaatgattctccgacagacgctgggctccacatcccacccctcccagcccgcgccccctccggtcctcgcgctccccggccgccacgtcccgggcagttcaggaaagcttgctaggtttccacgccggaaagcccaaggagaaggagccagcaggcctctgagcgtgtgagcgcgtgtgcgtgtcagcgcgtacatgggggtgttttcctcttcgggaagtgttatcaaacagtaatagctaccctcgactccgaatcacagcattccccccagaattcctgatcagtaaaacccaaatcgttttcaagacaaaggagcatcaatcagcgacaaagacagatttaacgtattaaatctttattaaagtgaagtcattcttattgaaatgatgtattgggtgtgcagaaagattggatttttttttttttttttttttgacaatgtgtaaaatggagatggtggcggagagcttgcgccgcgtcttgccctgattgttctgggctgggattggattactgggactgcccagggtcccgcgccaggaaacaccaccttggactacagggaagagactgatctccctcctcctgccggcccccacgttgatttcccgagaaacaagcgtgtcccaggtcttctcaaaaacttccctccttggtctccgcattagggaaactgaggtactgctggcatggctgtccatacgtttgctaaatcagctactccagaggcctagagaagggagggaacgccctgggttttccagaacaagacacagatctctccgtagcctaaagaaagtccttgcgccccaggtctgaaagccaaggggagcctgtgtttgctcccagcggggtcgccggccgtctccacaacccttgcttcctacaggcagaattgaatgcaggagctggctgtcttcccgcctggggtgggctctcaattcaactggacctcgggtcctgtcaagg

SEQ ID NO: 125643 - DNA, 1547 bp, Homo sapiens
  misc_feature 1..1547: note = chr6:10389909-10391456
  misc_feature 1..1547: note = Hyper
  source 1..1547: mol_type = genomic DNA
ctccacataagcagtcgatttctgtggtttcaaagaaaaaaaaaaaaaagatgaaacatgtcttctctttgagggtgacctttgacctttctttccaatacacctgacacaaagggcttagaaaagacccgtttcgggtgcggggtgctgatgctgcttttttgttgttcgtttgcgctcgcgctcgctctcgctctctctctgcatccccctcaccccctttctcggagactgaactaagtgaaaagttgtttcaataatcgcagctctctgctccgccagggccgagggaggcgggcggaacacggagggtgttttgttaaatgctcccgtcgttcgcaggggctgggacttgataaaaggagacagttttctgaaaagatttgattgaaatggcgtgtgccagggctgatgggagccagcgagggacaaagcgccgagaatccatggacactcgagcaattatgcctccacgctgaaggtggattagcgcgctggaaagaagcatatgtttggcccggggcgacacttccccccggctgagcttagagaatgggagcgcggagagcggctggacccggaatatcaactatctgcgaagcccccccttctagcccaactccgccagcctccccgcccccgccggggaaaagtcggagtgcatttttacaaagatgagaggagaagagagggctaggggaggagcgggcagggaggggagtaggtgcctagaggtgcaaatggccctgggatcccccaggagcggccctccaggctctcctctctggcgatcccgagggcgcgtccgtccttgggtgtggaaacccagagggggtcaaataaatgctcccctatggaatttcccactgctaaggtagttcggtccaggatgcccgctcaacgcgtattggaaggtcagccgaattgttgcaatgaaacaaggttttaatgactaaagatgcaagtgcctaaaaggttgcgttgggcaggaggcgcttggagggcagcgcgggttcccagccattccttgggtccaggtcgaggaaggcctcgggagacgagtcccacagtgagatatttgatgaaatgggtcggggctggaaagctcggacaggccgcatgggagagaaagggtgcgggtgcggcagtcggatccccacgcagctctatctgcttagacacccgggcgagggatgctttgggagtttggagccagaaagtttcccagaccctgcctccagtcattaattaaagcgcccttcccgtggaaaaaaaaaaggcccttaaaactctgacctggagcctcccggctcttcctcactgcacccgcaagcgcgctaagggagacgggaggcacaagcaagtcccaaacctttctctgggttttactgcagtttaattgggtctatcctggacgcgagtgccggtggccgctgcccaggccgtccacatttccctccctggctgtccttcgagcccctaccagtccttcctctccctgccgcccaagcccaggcaagactcgaaccgcccgtcccacacaatct

SEQ ID NO: 125644 - DNA, 44 bp, Homo sapiens; identical to SEQ ID NO: 94501
  misc_feature 1..44: note = chr6:10404465-10404509
  misc_feature 1..44: note = Hyper
  source 1..44: mol_type = genomic DNA

SEQ ID NO: 125645 - DNA, 111 bp, Homo sapiens; identical to SEQ ID NO: 94502
  misc_feature 1..111: note = chr6:10404879-10404990
  misc_feature 1..111: note = Hyper
  source 1..111: mol_type = genomic DNA

SEQ ID NO: 125646 - DNA, 504 bp, Homo sapiens; identical to SEQ ID NO: 94503
  misc_feature 1..504: note = chr6:10410444-10410948
  misc_feature 1..504: note = Hyper
  source 1..504: mol_type = genomic DNA

SEQ ID NO: 125647 - DNA, 783 bp, Homo sapiens; identical to SEQ ID NO: 94504
  misc_feature 1..783: note = chr6:10411253-10412036
  misc_feature 1..783: note = Hyper
  source 1..783: mol_type = genomic DNA

SEQ ID NO: 125648 - DNA, 299 bp, Homo sapiens; identical to SEQ ID NO: 94505
  misc_feature 1..299: note = chr6:10413015-10413314
  misc_feature 1..299: note = Hyper
  source 1..299: mol_type = genomic DNA

SEQ ID NO: 125649 - DNA, 348 bp, Homo sapiens; identical to SEQ ID NO: 94506
  misc_feature 1..348: note = chr6:10414201-10414549
  misc_feature 1..348: note = Hyper
  source 1..348: mol_type = genomic DNA

SEQ ID NO: 125650 - DNA, 508 bp, Homo sapiens; identical to SEQ ID NO: 94507
  misc_feature 1..508: note = chr6:10414821-10415329
  misc_feature 1..508: note = Hyper
  source 1..508: mol_type = genomic DNA

SEQ ID NO: 125651 - DNA, 447 bp, Homo sapiens; identical to SEQ ID NO: 94508
  misc_feature 1..447: note = chr6:10415389-10415836
  misc_feature 1..447: note = Hyper
  source 1..447: mol_type = genomic DNA

SEQ ID NO: 125652 - DNA, 260 bp, Homo sapiens; identical to SEQ ID NO: 94509
  misc_feature 1..260: note = chr6:10416118-10416378
  misc_feature 1..260: note = Hyper
  source 1..260: mol_type = genomic DNA

SEQ ID NO: 125653 - DNA, 633 bp, Homo sapiens
  misc_feature 1..633: note = chr6:10417158-10417791
  misc_feature 1..633: note = Hyper
  source 1..633: mol_type = genomic DNA
ctgagcacaattcctcggctgaaccgggctggaggcttggcgccgccctccgtccagaaaatggtcgactttccagggctagaccctgcagggctgtcccagcctgtcgccagtgcagtggtttgaagtcaggatctgggctgccaggagcaccgacaccctcccagcagcggccatagcctgagcaggccaaaccctaggcctgagagcatgggtttttacactccgtagacgtcgccgcggtgtgcttaagggaactccaagtttcgctttcttgccctctgcgggcttggaaaggccgccctccatcctctgccaccccatttcaacccccgtttccacctccccgctgccccgcgcccaacagatctccggctccgcacccgctggggctgctaaactgttgttgtattcccgccgagggcgccattgaggtgcagattgggacctgccggctctggactgccgcccccggtgtaggcgctgatgaaaggcccgggcgagcgccagggtcgcctctggagccagccgagctgcatttatgccagcgtcattaccacgctaagtcgcttcattgcatgtcaatgctccggcggggccagaaccccgggacagcagcgccaggcctggggt

SEQ ID NO: 125654 - DNA, 1191 bp, Homo sapiens
  misc_feature 1..1191: note = chr6:10419077-10420268
  misc_feature 1..1191: note = Hyper
  source 1..1191: mol_type = genomic DNA
tctcctacagaaacacgctgcctccgcgacccagccatctggacccctttccattcttcacacatcctagatctcccgaaatctgggggtaccaagagagacaggtgcaccagaacctgtccaacactcaaccctggggtctagggcgaggccgcaggcgcagcaggctgaaaaccttcaccgccgcgcaccacaaccccaggccttctccctccccccttccgaattagtcatcctcccaagtttctacttgaggtgggaggggggtgggggaaacggccacagcacaaaccacaagtgacccaccaggccacctgtggagcgtgcgccggacttccccggcgccgggccccgcgggctgcgcgctttgcgcccagcaccgcagtcgctgcctgcgcccgtttttcctgtcttcgctgtctcctgggagctctcctgggcgctgccaggcgcgcctcacctacgactcccctgccctgggccacggcgcttcctctcctcctccccgctccggccccctcccctactccacccctgcccacctcaaccccagccaaggcaaaccccccgtacctgccagtcccccattttggcaagtatggacatcgcggctctgcgctcctggcgactggtccccgccgggcatgggctggagggctcggtcgggccagctccctggaatcgcttaggcaaatcctccttttttacctgctcaccaacatctcacctggtcataaagagctgggttgctacctgccgacgcatgcgcgctggcccaggaattcactccgccagctgcagtcccagcgccgcacagagctgacctgggaagtgatggatttatagccgcggcaatcttgccatcagctccagcttttcccaacagccccaacccgctttcccggtcagtccctggcccgggaaccgaagctgactgactgctggatgtgctgggtgcgatgcgagtgtgagtgtgttttcgcactccagtggtggggcatcgacaagctcgacccatggctagcctcccctcggaactttcgaactgggggagtctccactcccgggtgggggtcgggggttggggaagggctagactgctagaagcgtccagaccccatgatccccgcgcacctggacacagtggggacaggtcgccgtccccgcctccccacccgcccacgaggtgca

SEQ ID NO: 125655 - DNA, 365 bp, Homo sapiens
  misc_feature 1..365: note = chr6:10420718-10421083
  misc_feature 1..365: note = Hyper
  source 1..365: mol_type = genomic DNA
ctttaaaagaagccacgggatttggggctcccggagccgcacctggccaggagggaggtgagggtgaggagattggcctcgggccacactctcccagagacggtgccagtcccattccgcggctatgagatcgaattgtcctgggtctaggcctgggacgcctgggccaggcccagttaccctcccgggctgctgtcgccgggacttggagacgaacaaagaaccagttttaaatcgtcttctctgacatgtcaggcaaatatgtgtaaaaggtcagctccacgctgtggagcagagacctgtcccccaggcaccaaaacctcccctttctaaccgtgcccgagagcctccgacccctgggccct

SEQ ID NO: 125656 - DNA, 1351 bp, Homo sapiens
  misc_feature 1..1351: note = chr6:10421356-10422707
  misc_feature 1..1351: note = Hyper
  source 1..1351: mol_type = genomic DNA
ctggctttttccagacggtggaaatagggcggtgactaacttttcagagtggaagacacgcacgaagggcgcacctgcagctctccgggattcaggcgggggtcgctgtgctctcttaaaagtgagcggcggtttcagcctgccaccgcttcgcctcgccagctcggaggaaactctggctggaggcgacctcgggcccagccggacgggccgggccgagcctaggaggggctggcagacgtgtcccagggccagggtggggcgtagggagcgccgtctccaccctcagtacttttggggtgggggacctgagcgtgcggagagcgggaggcagagctgagagcggggttaagcgcgaagctaaggcgccgcatagggttgggtgggaatggacagggtgagctggaagcgaagcaccccagccaggccttaggagagaggaccgtcggcatctgtgcacatcctagcgggcggatgatgtgggagagaggcggagggaggtgaaatgcgggagctagaatttagctttgcagtgaggtcacttggggtctgcattcagctccgatatatacatgtaggggctgtgtgatcctggggaagttaccgaccttgtctgaactcctgtttcctggtttgtaaagtggctaattggtgggaattcaataggagaatgtgcgcaaaacgcttagcacagcgcctggccaacaatgcgctctcaagaaaggctgctgagccttgtccaggacggtctacaccgccccacgtccaagatgagttcacagcgcccaagacctgttcaatttaagatgatgtaaactgcattgcccttcttagacacgcagcagccaggagctggtcatctgcacctcccgcgatttcctcctcagaaccccagtcctgccagatttgcgtccttccctggctcctcaaacacctgctgcaccgctcagagcctttccccaccccgacctcctccgcagctccgcaccagcgagactgcgccccgtggcacctcgggggtgccacgattggcgggggatgggggatgcctcccagcttcatccgctctccgggttccagacaaccattccggagagccagctgctctcagtgcgggcaggcccaaggccactaactgcacttggcgacccacctccgttcccaagaggcctcggaaagtgcggcctcgggtctcttttgaaacagagacccgcggcaccccgcttctccccctgggataggagagggagagccgcgggagttccgcagccactcctggcgctgccaccacgaagcaggttcactagctaacagggcctgggacactgagccgtgtcgcaaacttttctgt

SEQ ID NO: 125657 - DNA, 169 bp, Homo sapiens; identical to SEQ ID NO: 94518
  misc_feature 1..169: note = chr6:10423918-10424087
  misc_feature 1..169: note = Hyper
  source 1..169: mol_type = genomic DNA

SEQ ID NO: 125658 - DNA, 1575 bp, Homo sapiens
  misc_feature 1..1575: note = chr6:10425382-10426957
  misc_feature 1..1575: note = Hyper
  source 1..1575: mol_type = genomic DNA
agggaaagtctgcctcgatctgtagcagagttttgggattgactttctaaactgcagccactcctcatctttggccttgtgaaaaacttgagaccccggctttatcagtcccccttttgaaaaacagggcgtgtctcagccctaggtatgcaaagctaaacgtctcaaaccgctctgcattcgaattagccaacttaagaacaagtccaacagcactgctaagcaagagcctaataactcagcgtttcgcgacatctcttggcggcgttgaccgtttgcccgggacactggtttagaagcacggcatagggtgtctctacatcttagaaatcaagacagcctctaggttagaataaagtttactctggactgggcataactccactccacctctgcgattcttcttctcgtttcccgtcttctgtcttttctttcctcccttcccaactcctagcgcgctactttaacgtctcagtctcgttcgctaagcccatgcgcctgggacttgttctttgaatctcaagtccgaaaagccaggaatcctcgatcatggacttcctcctgctaaattagagggagtgaaatttcgctctcctctccatcctacttccccatcccaaactcgctagattaagttcgctgaccaggcgcgcacccaatggcagcaccctctccaacattttccccaccagagaggcaagtgtcctacatttgtacgtaaaggtccctgagtggctaggtggagaggctcggatgtcttttcctggagcgggcctcggggagctgcagcagccccagcctcaggcaccacagccaagcgagcgcgccttgggctcgctgctctgcacgcagctggaggtctgggccgctgaccctctggccacgtagtcaacccgaggatgtgtgccccggggctcggccttgcctcgggtgagaaggctagtcaccattcagggtgcaggtgtcatggcctggaaatggcaatatctgagcaaacaggtgggcgtcgcttcccggcggtgcggtggccgctggctcgcagcgcgctccagctttcggcgccgccgccgcccctttgctctgcggactcagccagttcccgggtggcccagctgggtggctccgaggcctgcccccttgggctgcggcgggaggcggggactgcagtgccgagtgtagggcgccccagccgggctggcggttcacgctgcgctcgggcctctgccgggagggcgccctggcgccaaacccgggcgggcaggggggtggagagccgattgagtttattcccattcagaatttagaggctggtggagacagagagtctcctaaatggatgcaagtctcctgaaagtctgggccggaagcctcgaaactttctgccacgcaaagccccagctagtctccagggctcggtcctggttccctttgtgcaggcccggaagtgtccgcccggttttcccactgcctggaggggcccagggtcgcggatagactcggacaaggctccgtttactttcagtttgtcttagttgactaatggcgggactggttgtaatgcgtgctctgagattt

SEQ ID NO: 125659 - DNA, 265 bp, Homo sapiens
  misc_feature 1..265: note = chr6:10528476-10528741
  misc_feature 1..265: note = Hyper
  source 1..265: mol_type = genomic DNA
agtcatatgccatgtcgtatagcatacccagccaatggggagagcgaggtgtggctgtggaaaaagacagggttaagcaatttttttaaagcactacatatttattgatagaatatctctccaggcagtattcacatgctttaaactgaagctcgtagcttggcagtgcagtttaagcaaataaactcaggctgttgaacacaatgattaacaggaagcaggggaggggacatagttactagactctggccgggacaagaggctg

SEQ ID NO: 125660 - DNA, 42 bp, Homo sapiens; identical to SEQ ID NO: 94534
  misc_feature 1..42: note = chr6:10541735-10541777
  misc_feature 1..42: note = Hypo
  source 1..42: mol_type = genomic DNA

SEQ ID NO: 125661 - DNA, 30 bp, Homo sapiens; identical to SEQ ID NO: 94541
  misc_feature 1..30: note = chr6:10591675-10591705
  misc_feature 1..30: note = Hypo
  source 1..30: mol_type = genomic DNA

SEQ ID NO: 125662 - DNA, 78 bp, Homo sapiens; identical to SEQ ID NO: 94542
  misc_feature 1..78: note = chr6:10595774-10595852
  misc_feature 1..78: note = Hypo
  source 1..78: mol_type = genomic DNA

SEQ ID NO: 125663 - DNA, 30 bp, Homo sapiens; identical to SEQ ID NO: 94549
  misc_feature 1..30: note = chr6:10659521-10659551
  misc_feature 1..30: note = Hypo
  source 1..30: mol_type = genomic DNA

SEQ ID NO: 125664 - DNA, 41 bp, Homo sapiens; identical to SEQ ID NO: 94556
  misc_feature 1..41: note = chr6:10776289-10776330
  misc_feature 1..41: note = Hypo
  source 1..41: mol_type = genomic DNA

SEQ ID NO: 125665 - DNA, 559 bp, Homo sapiens
  misc_feature 1..559: note = chr6:10881854-10882413
  misc_feature 1..559: note = Hyper
  source 1..559: mol_type = genomic DNA
gactcttcaagaactcgaatgccattctccctccttcggatggacagcgccccgcgtgcccgcacacacccggttcacttacctgaggcatctgcggatcgttgatgtcccagctgagctgcatcccgtaggagcacacgccgaccgcttcctgcaccgcggccgccggcatctgcccaactcgctcgcgctttccgcccagggttctgaaaaatagaagaaaaaaggacaggtgcgccaggtgggttttttttcttctctttaaagaagaaagtggggtgtgtgaaggggaggtgcagagagagagaaagagagagaggctgtttagatatctggaagctggggacaatggttatggacccgggcggggccttgtccttggccgcggtgctgaacgttctccacccgaacggcagcatcgacctctggcagctgccccctcctttataaagatatacctccggggggctccgccctgtctcgcctacctcgctagcgcccacgctccaggggccggtcgccccctccaccacagtcccaggaacggaggtggaggtta

SEQ ID NO: 125666 - DNA, 385 bp, Homo sapiens
  misc_feature 1..385: note = chr6:10883008-10883393
  misc_feature 1..385: note = Hyper
  source 1..385: mol_type = genomic DNA
ttgggcctccactgccggctcttcccctaactattgtgagtgtctcgcagtcttggctctgctgtttgggacgtgccagggtgcgccaagcctccgcgtatgctcgcgagcccaggcgccttcacgctcccggggacttcggagggacctggccctgcaggaacggagtcctacaaagtgaacctggaggaggtggggggcggaaatgagcccggggtaggtgggagcctggggtaggtgggagcctggggaaggagggaaaggggagaggggaaaagtcccaaagaactcgctttctccactgctttggctccctctgggtctcagcttccttatctgtttatctgttaaataagaggttgtggttcggcgagctctcagttgc

SEQ ID NO: 125667 - DNA, 799 bp, Homo sapiens
  misc_feature 1..799: note = chr6:10886917-10887716
  misc_feature 1..799: note = Hyper
  source 1..799: mol_type = genomic DNA
attacaggcgtgagccaccgcgcctggccgcccctctggctttttaaggcggggcaaaaacttggaacagctaccacaaagcgaacgcctatctgtttggaatttcgcaaataaggaacgtttaaatgacgtagttcacatcctttgagtgctggctttctcttaaagggtgagtgcgtgcgcccaggtggtttggcctgtgtgcgctagttacttgcacgcgcttcttgagtctcaaaacacagagctctagtaaacttcagggggcggattcgtcaattacagttgcggaagaagactcgactcgaagagcggtccgccaccagggctctttcggcagcgcccccagcgggcggggctcttgggcggggaagcaggagagggccgaccgagcgcaacaaagctgagcggcgcgtcgcttcaggaacgaagaagcctcgttatgcaagcggtgagtgacccccgaagggcccggaccttctgtccacagtgctagggcgcgcgagggcgcggggtccctggggctcaggttctgccgccttgaggtgttcgctcagagaccgggtgctgggcatagtcccccgccacctccttgggtttgctcggagtgtattggcagcctgcggggagaccaggcagaatagaaacctcggatccctagctaaatagcgctcagggaaaggggaaccggagaattcgtgttcggaaagcaatgagatagttcttttctagttgctttgcgtattttcctagccggttttccagccctctttccaccttgctgcgtagaaagtgcaga

SEQ ID NO: 125668 - DNA, 1229 bp, Homo sapiens
  misc_feature 1..1229: note = chr6:11043701-11044930
  misc_feature 1..1229: note = Hyper
  source 1..1229: mol_type = genomic DNA
cacacacacacacacacacagcttactgccgaggagaaagaagcgttactaatccagagtggaggactggcctgggaaatcgggcagagagaggagttgtcggaaagaacacaccagaagcccctccgagcccagacactgatagaaacccagccgcttcccaagccaatctgcaaacccaggaggcacccacgagtgcacagacacacccccggggtgcaggcgcggtgaagggaggagaggggcaagagcttgaccgttagggcccgaaccccagaactcccgaggcagggtgtgtgccgcgcgcgggaaacgccgttctccgctccaggcgtcggcgggcggtggcgagagcaggttcgggggtccggagggtcggagggtgggctgcgcgcgggaatggccgccgcgaaggaggggcggcttcctcgggcatcccgggcgcccggccccgtgcatgcaacaggggactgggcgcgagcgggcgcctcgaggtgccggggcgggaccggggagaggggaccgagacaaagttcccgagacccgcgggcctcgggccgacccgcgcgcccccggcccaaacgctcagctcccgctccccaggcccgcgcggacccggcccctccgagggtagcgggttccagcggcgaacccgcagcgcccgcgccggcgcccgctcggccctttcccgcccggtgcgtgggtccaggagagaaagaaagcgcggcggtgtcggtggcggcgcgcggccccactcaccatgatccgcagcggctgtggcgcggcgacccgggcgggcggcgatgcgctgtccagggtagccgggtccctctgcccggcgctatctcggcgcccgcgccggttacccccacccacacccacgcccggcgcgcgcacacccgcccgcgcctccccgccccctcgggctcgcgccgccgccgcgcggcgctccgagcctcggggccgtttcgtccccgccccctctcccacaggggcctcgccggccgccgcgccaggagggcgcgcgggggaggggcgcagggcaagtgaggcggcgccccccgcccctgcggcctcgcgcgccccctcctgggcgaccgacctcgccctcgcgtccgcggcgtcccctgccggccgggcggcgatttgcaggtccagccggcgccggtttcgcgcggcggctcaacgtccacggagccccaggaatacccacccgctgcccagatcgg

SEQ ID NO: 125669 - DNA, 30 bp, Homo sapiens; identical to SEQ ID NO: 94612
  misc_feature 1..30: note = chr6:11288375-11288405
  misc_feature 1..30: note = Hypo
  source 1..30: mol_type = genomic DNA

SEQ ID NO: 125670 - DNA, 17 bp, Homo sapiens
  misc_feature 1..17: note = chr6:12194739-12194756
  misc_feature 1..17: note = Hypo
  source 1..17: mol_type = genomic DNA
aaaggacaaacaggccg

SEQ ID NO: 125671 - DNA, 48 bp, Homo sapiens; identical to SEQ ID NO: 94668
  misc_feature 1..48: note = chr6:12222846-12222894
  misc_feature 1..48: note = Hypo
  source 1..48: mol_type = genomic DNA

SEQ ID NO: 125672 - DNA, 142 bp, Homo sapiens; identical to SEQ ID NO: 94669
  misc_feature 1..142: note = chr6:12287999-12288141
  misc_feature 1..142: note = Hypo
  source 1..142: mol_type = genomic DNA

SEQ ID NO: 125673 - DNA, 349 bp, Homo sapiens; identical to SEQ ID NO: 40747
  misc_feature 1..349: note = chr6:12288379-12288728
  misc_feature 1..349: note = Hypo
  source 1..349: mol_type = genomic DNA

SEQ ID NO: 125674 - DNA, 30 bp, Homo sapiens; identical to SEQ ID NO: 94698
  misc_feature 1..30: note = chr6:12626382-12626412
  misc_feature 1..30: note = Hypo
  source 1..30: mol_type = genomic DNA

SEQ ID NO: 125675 - DNA, 164 bp, Homo sapiens; identical to SEQ ID NO: 94708
  misc_feature 1..164: note = chr6:12749336-12749500
  misc_feature 1..164: note = Hyper
  source 1..164: mol_type = genomic DNA

SEQ ID NO: 125676 - DNA, 649 bp, Homo sapiens
  misc_feature 1..649: note = chr6:12749820-12750469
  misc_feature 1..649: note = Hyper
  source 1..649: mol_type = genomic DNA
ccctcctcccccttccgcctctctccctctccctccgtctccttctccctctcagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcaggtaagaacgcccctggcgccgcgcccccgcccccgccctgctccctccctccccggctgttgagcccccgcccctcccgggcgtcctccccgccgccccccgcagtcgggcgctcagcactcgcgctctttgtgtctccggtgcgcagagggcgtgtgtgcgagctacggggtgggggagggcggcgcgtgcagccccacatccgcccgagtcccacgcgggcttccccggcacggggaggaggaagtgctgtcagtgaccacagtgatcccgggaataacccggagcccgggccgcgcgcccatgcgcaggctgcgggcgcggggtctggcgaggctccccgggcgaggttggctggcgcggctactacggggtggaacttgttggtgacattcagactctgttggctttgacgggttgacgccgccgctgcggtgttggagtggg

SEQ ID NO: 125677 - DNA, 30 bp, Homo sapiens; identical to SEQ ID NO: 94711
  misc_feature 1..30: note = chr6:12770884-12770914
  misc_feature 1..30: note = Hypo
  source 1..30: mol_type = genomic DNA

SEQ ID NO: 125678 - DNA, 506 bp, Homo sapiens; identical to SEQ ID NO: 30320
  misc_feature 1..506: note = chr6:13013570-13014076
  misc_feature 1..506: note = Hyper
  source 1..506: mol_type = genomic DNA

SEQ ID NO: 125679 - DNA, 30 bp, Homo sapiens; identical to SEQ ID NO: 94729
  misc_feature 1..30: note = chr6:13044971-13045001
  misc_feature 1..30: note = Hypo
  source 1..30: mol_type = genomic DNA

SEQ ID NO: 125680 - DNA, 178 bp, Homo sapiens; identical to SEQ ID NO: 94739
  misc_feature 1..178: note = chr6:13118018-13118196
  misc_feature 1..178: note = Hypo
  source 1..178: mol_type = genomic DNA

SEQ ID NO: 125681 - DNA, 145 bp, Homo sapiens; identical to SEQ ID NO: 94751
  misc_feature 1..145: note = chr6:13180876-13181021
  misc_feature 1..145: note = Hypo
  source 1..145: mol_type = genomic DNA

SEQ ID NO: 125682 - DNA, 159 bp, Homo sapiens; identical to SEQ ID NO: 40748
  misc_feature 1..159: note = chr6:13288514-13288673
  misc_feature 1..159: note = Hypo
  source 1..159: mol_type = genomic DNA

SEQ ID NO: 125683 - DNA, 51 bp, Homo sapiens; identical to SEQ ID NO: 94759
  misc_feature 1..51: note = chr6:13293172-13293223
  misc_feature 1..51: note = Hypo
  source 1..51: mol_type = genomic DNA

SEQ ID NO: 125684 - DNA, 207 bp, Homo sapiens; identical to SEQ ID NO: 94778
  misc_feature 1..207: note = chr6:13488388-13488595
  misc_feature 1..207: note = Hyper
  source 1..207: mol_type = genomic DNA

SEQ ID NO: 125685 - DNA, 18 bp, Homo sapiens
  misc_feature 1..18: note = chr6:13510401-13510419
  misc_feature 1..18: note = Hypo
  source 1..18: mol_type = genomic DNA
tggagtacaatggtgcga

SEQ ID NO: 125686 - DNA, 17 bp, Homo sapiens
  misc_feature 1..17: note = chr6:13510479-13510496
  misc_feature 1..17: note = Hypo
  source 1..17: mol_type = genomic DNA
accgacttcaagaatga

SEQ ID NO: 125687 - DNA, 105 bp, Homo sapiens; identical to SEQ ID NO: 94792
  misc_feature 1..105: note = chr6:13767864-13767969
  misc_feature 1..105: note = Hyper
  source 1..105: mol_type = genomic DNA

SEQ ID NO: 125688 - DNA, 22 bp, Homo sapiens
  misc_feature 1..22: note = chr6:13829036-13829058
  misc_feature 1..22: note = Hypo
  source 1..22: mol_type = genomic DNA
cctactgggggaactcgccccc

SEQ ID NO: 125689 - DNA, 699 bp, Homo sapiens; identical to SEQ ID NO: 30322
  misc_feature 1..699: note = chr6:13924890-13925589
  misc_feature 1..699: note = Hyper
  source 1..699: mol_type = genomic DNA

SEQ ID NO: 125690 - DNA, 30 bp, Homo sapiens; identical to SEQ ID NO: 94828
  misc_feature 1..30: note = chr6:14002445-14002475
  misc_feature 1..30: note = Hypo
  source 1..30: mol_type = genomic DNA

SEQ ID NO: 125691 - DNA, 30 bp, Homo sapiens; identical to SEQ ID NO: 94829
  misc_feature 1..30: note = chr6:14140908-14140938
  misc_feature 1..30: note = Hypo
  source 1..30: mol_type = genomic DNA

SEQ ID NO: 125692 - DNA, 156 bp, Homo sapiens; identical to SEQ ID NO: 40750
  misc_feature 1..156: note = chr6:14203256-14203412
  misc_feature 1..156: note = Hypo
  source 1..156: mol_type = genomic DNA

SEQ ID NO: 125693 - DNA, 76 bp, Homo sapiens; identical to SEQ ID NO: 94834
  misc_feature 1..76: note = chr6:14281293-14281369
  misc_feature 1..76: note = Hypo
  source 1..76: mol_type = genomic DNA

SEQ ID NO: 125694 - DNA, 30 bp, Homo sapiens; identical to SEQ ID NO: 40751
  misc_feature 1..30: note = chr6:14999193-14999223
  misc_feature 1..30: note = Hypo
  source 1..30: mol_type = genomic DNA

SEQ ID NO: 125695 - DNA, 75 bp, Homo sapiens; identical to SEQ ID NO: 40752
  misc_feature 1..75: note = chr6:15073578-15073653
  misc_feature 1..75: note = Hypo
  source 1..75: mol_type = genomic DNA

SEQ ID NO: 125696 - DNA, 21 bp, Homo sapiens
  misc_feature 1..21: note = chr6:15129502-15129523
  misc_feature 1..21: note = Hypo
  source 1..21: mol_type = genomic DNA
acagtttcggccgggcgcggt

SEQ ID NO: 125697 - DNA, 30 bp, Homo sapiens; identical to SEQ ID NO: 94894
  misc_feature 1..30: note = chr6:15213893-15213923
  misc_feature 1..30: note = Hypo
  source 1..30: mol_type = genomic DNA

SEQ ID NO: 125698 - DNA, 87 bp, Homo sapiens; identical to SEQ ID NO: 94895
  misc_feature 1..87: note = chr6:15223030-15223117
  misc_feature 1..87: note = Hypo
  source 1..87: mol_type = genomic DNA

SEQ ID NO: 125699 - DNA, 37 bp, Homo sapiens; identical to SEQ ID NO: 94904
  misc_feature 1..37: note = chr6:15302352-15302389
  misc_feature 1..37: note = Hypo
  source 1..37: mol_type = genomic DNA

SEQ ID NO: 125700 - DNA, 40 bp, Homo sapiens; identical to SEQ ID NO: 40753
  misc_feature 1..40: note = chr6:15456031-15456071
  misc_feature 1..40: note = Hypo
  source 1..40: mol_type = genomic DNA

SEQ ID NO: 125701 - DNA, 40 bp, Homo sapiens; identical to SEQ ID NO: 94917
  misc_feature 1..40: note = chr6:15512658-15512698
  misc_feature 1..40: note = Hypo
  source 1..40: mol_type = genomic DNA

SEQ ID NO: 125702 - DNA, 30 bp, Homo sapiens; identical to SEQ ID NO: 94941
  misc_feature 1..30: note = chr6:15802460-15802490
  misc_feature 1..30: note = Hypo
  source 1..30: mol_type = genomic DNA

SEQ ID NO: 125703 - DNA, 185 bp, Homo sapiens; identical to SEQ ID NO: 94947
  misc_feature 1..185: note = chr6:15843746-15843931
  misc_feature 1..185: note = Hypo
  source 1..185: mol_type = genomic DNA

SEQ ID NO: 125704 - DNA, 30 bp, Homo sapiens; identical to SEQ ID NO: 94995
  misc_feature 1..30: note = chr6:16140263-16140293
  misc_feature 1..30: note = Hypo
  source 1..30: mol_type = genomic DNA

SEQ ID NO: 125705 - DNA, 182 bp, Homo sapiens; identical to SEQ ID NO: 94998
  misc_feature 1..182: note = chr6:16148438-16148620
  misc_feature 1..182: note = Hypo
  source 1..182: mol_type = genomic DNA

SEQ ID NO: 125706 - DNA, 266 bp, Homo sapiens; identical to SEQ ID NO: 95016
  misc_feature 1..266: note = chr6:16197009-16197275
  misc_feature 1..266: note = Hypo
  source 1..266: mol_type = genomic DNA

SEQ ID NO: 125707 - DNA, 25 bp, Homo sapiens
  misc_feature 1..25: note = chr6:16197335-16197360
  misc_feature 1..25: note = Hypo
  source 1..25: mol_type = genomic DNA
cctaaggtggcgcagctggagttgt

SEQ ID NO: 125708 - DNA, 151 bp, Homo sapiens; identical to SEQ ID NO: 40755
  misc_feature 1..151: note = chr6:16218420-16218571
  misc_feature 1..151: note = Hypo
  source 1..151: mol_type = genomic DNA

SEQ ID NO: 125709 - DNA, 145 bp, Homo sapiens; identical to SEQ ID NO: 40756
  misc_feature 1..145: note = chr6:16249815-16249960
  misc_feature 1..145: note = Hypo
  source 1..145: mol_type = genomic DNA

SEQ ID NO: 125710 - DNA, 42 bp, Homo sapiens; identical to SEQ ID NO: 95033
  misc_feature 1..42: note = chr6:16288325-16288367
  misc_feature 1..42: note = Hypo
  source 1..42: mol_type = genomic DNA

SEQ ID NO: 125711 - DNA, 192 bp, Homo sapiens; identical to SEQ ID NO: 95035
  misc_feature 1..192: note = chr6:16293373-16293565
  misc_feature 1..192: note = Hypo
  source 1..192: mol_type = genomic DNA

SEQ ID NO: 125712 - DNA, 40 bp, Homo sapiens; identical to SEQ ID NO: 95036
  misc_feature 1..40: note = chr6:16295428-16295468
  misc_feature 1..40: note = Hypo
  source 1..40: mol_type = genomic DNA

SEQ ID NO: 125713 - DNA, 154 bp, Homo sapiens; identical to SEQ ID NO: 95038
  misc_feature 1..154: note = chr6:16356093-16356247
  misc_feature 1..154: note = Hypo
  source 1..154: mol_type = genomic DNA

SEQ ID NO: 125714 - DNA, 180 bp, Homo sapiens; identical to SEQ ID NO: 95039
  misc_feature 1..180: note = chr6:16359260-16359440
  misc_feature 1..180: note = Hypo
  source 1..180: mol_type = genomic DNA

SEQ ID NO: 125715 - DNA, 41 bp, Homo sapiens; identical to SEQ ID NO: 95097
  misc_feature 1..41: note = chr6:16444348-16444389
  misc_feature 1..41: note = Hypo
  source 1..41: mol_type = genomic DNA

SEQ ID NO: 125716 - DNA, 73 bp, Homo sapiens; identical to SEQ ID NO: 95253
  misc_feature 1..73: note = chr6:17102273-17102346
  misc_feature 1..73: note = Hyper
  source 1..73: mol_type = genomic DNA

SEQ ID NO: 125717 - DNA, 30 bp, Homo sapiens; identical to SEQ ID NO: 95254
  misc_feature 1..30: note = chr6:17102637-17102667
  misc_feature 1..30: note = Hyper
  source 1..30: mol_type = genomic DNA

SEQ ID NO: 125718 - DNA, 243 bp, Homo sapiens
  misc_feature 1..243: note = chr6:17281019-17281262
  misc_feature 1..243: note = Hyper
  source 1..243: mol_type = genomic DNA
ccagccctaccccatcgccggctacagagcgggagccccgagccccagcgccgcgccgcgcggggagagaagcagctgttcccaacagctggggggcggcggcgcccggcgccccaggtgctgccgcggccaatcgcaggcgtccggcccgcccccctccccagccgggcgtcgacccccggcccgcgggggaagggagcagagaggtggagagctgtcctcggcactcgtcttccagatccc

SEQ ID NO: 125719 - DNA, 119 bp, Homo sapiens; identical to SEQ ID NO: 95257
  misc_feature 1..119: note = chr6:17282098-17282217
  misc_feature 1..119: note = Hyper
  source 1..119: mol_type = genomic DNA

SEQ ID NO: 125720 - DNA, 19 bp, Homo sapiens
  misc_feature 1..19: note = chr6:17339508-17339527
  misc_feature 1..19: note = Hypo
  source 1..19: mol_type = genomic DNA
acttcgtctcaaaaaaaca

SEQ ID NO: 125721 - DNA, 190 bp, Homo sapiens; identical to SEQ ID NO: 95259
  misc_feature 1..190: note = chr6:18035825-18036015
  misc_feature 1..190: note = Hypo
  source 1..190: mol_type = genomic DNA

SEQ ID NO: 125722 - DNA, 405 bp, Homo sapiens; identical to SEQ ID NO: 95260
  misc_feature 1..405: note = chr6:18122677-18123082
  misc_feature 1..405: note = Hyper
  source 1..405: mol_type = genomic DNA

SEQ ID NO: 125723 - DNA, 610 bp, Homo sapiens
  misc_feature 1..610: note = chr6:18277433-18278043
  misc_feature 1..610: note = Hyper
  source 1..610: mol_type = genomic DNA
ttcctaaagagggtgcgtttgtggggaaggtgagtgcgcgcgcgcggagggagggccggccgcggagaggggccaaaactcttcggaatcagcagccagagaggctctgagggcgcccgcggggcggaggggagcggggcagagggccgccggggcgagggccgaggaggggtccgagacgcgccaaggggctggtagctaggcgacctgaatgtcttccatacctgaacccgcagcctgaagaagctgatagcggaccccgagcgcgcgcgcgccttggcgggagccctgcgcctcccggggtctccctgctccttacttggacctcgggcgcaaggtaaggaggggcacggggtgcagcgttcgccctcgagctgcctggagcctctgcgaggggccagttcggcctccccgaggctgtcaccgcctccccttctgctccttccctttctccgtccccaggtcccctccgcgcagagctgaagccgcggcgggcggcccacgggggatcagaccctcgggcatccgcgtttcccctccgccgtccgccggacccccacctcttctccaagctccactcccgacttttcttccccgcccccgggaagct

SEQ ID NO: 125724 - DNA, 34 bp, Homo sapiens; identical to SEQ ID NO: 95263
  misc_feature 1..34: note = chr6:18507305-18507339
  misc_feature 1..34: note = Hypo
  source 1..34: mol_type = genomic DNA

SEQ ID NO: 125725 - DNA, 532 bp, Homo sapiens
  misc_feature 1..532: note = chr6:19691714-19692246
  misc_feature 1..532: note = Hyper
  source 1..532: mol_type = genomic DNA
tagttgctgaaaagccggggccttggagctttcggatcctgcccgcctttcatcatgtaaacaaacgcatcagatttaaagctttcccataattgttatgctaaccttggagcgcaacctctccatttgcatttgaaggagctaaatattaggcaggaaagaaagtgctctttttgaaagcctgagaaaatgtccccgctcggggctgctccgccatctgggccgcgggctgggcgcgcggctcccgcccccagctccttggcagaggcgccggaggaaggggcgccgcgaagggccgtcatcttgttggaaaagaatgcagaaatgcccccctaaggctgaatgagcaccacttccacactcagggcgggggaggccgggggacgtgggagcggcgcgccaggagcgaggcgtccctggtgacagcgcgtcccgagggctctcccttttcccagagcgcataccaaaggcagactcctttgcaggctccacgagccccattcgcggtggaaaggggcgttccagactgcag

SEQ ID NO: 125726 - DNA, 397 bp, Homo sapiens
  misc_feature 1..397: note = chr6:19836792-19837189
  misc_feature 1..397: note = Hyper
  source 1..397: mol_type = genomic DNA
aaagaaccccccccacgtttttgttttatttatattcccttcaccaaaaacctgcattcgattcggcattcttttccttctttttttttctacttttgctaagctttagcattttttaaaaagaaaacggaaaggctacacattccattccatcattatggtttcggcaaatgtgaaaaggcgaataatgaaacggaggagggaaatatagaacagaatgaacgtgccttcttgaacagcgcgtctttcttaaggcactggaatcccacggatggagtgatgggtggcggagggtccctgggcgccgtgctattaggagtggcagggtatccgcgagcagggcccaggcgctccctcagcagcctagtcgggataaggggggcggtggagagtgaat

SEQ ID NO: 125727 - DNA, 46 bp, Homo sapiens
  misc_feature 1..46: note = chr6:19837389-19837435
  misc_feature 1..46: note = Hyper
  source 1..46: mol_type = genomic DNA
ccactccagaccccccgcccactcctccactcgggtagccggactc

SEQ ID NO: 125728 - DNA, 453 bp, Homo sapiens
  misc_feature 1..453: note = chr6:19838167-19838620
  misc_feature 1..453: note = Hyper
  source 1..453: mol_type = genomic DNA
gctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggtgagaggccgggcgccggccgtgggcggacgccgcgggggatgggaggttggtggcgtggtggcgggacgcgggcgctcaccgtcctccgggcaggggcgggccaggaatgacagccccctccccctgctcctccgggctcccccgggccgccagcagccggccgggctcggcgagcgcgggtccgggagaac

SEQ ID NO: 125729 - DNA, 636 bp, Homo sapiens
  misc_feature 1..636: note = chr6:19838838-19839474
  misc_feature 1..636: note = Hyper
  source 1..636: mol_type = genomic DNA
gacagcattctgtgccgctgagccgcgctgtccaggtgagcgcgcatttcccgtctcgggtggccggtcaccagagacgcccgtccccgagggcttccggggccaggcaccgcggtgttctttgcccccagcgtttctgagagcaaactcccaaggaagtaaatcccctctctccctgccacctaagtagcaagtaaacccgtacttagccttagaactcgaggttcagtctcggtggagacgggtcagcccttgtccccgccgtccccgtgttttttctggtggtcagcgggctcttctgccttccctagttcccgagggagggcaccctcgtgggcatgggagctgccccggtgtcctcccgtgcagtctgtcacccacaaagggggacgcgggcagggcgccggagtgggtcccctctccgggcttcccgagggccgcagctgcctgctcggcgcctggcccggccgcgggcgggtgttgtctgacctggtggtttgttttgggttgttgatcaagcatgtcttgagtttggtcggtggcgccagttagtctgcagcgagaaggttcacacaccccctctattcattcctcttccacaggtgtgcggccgcctgagcccgagccaggagcact

SEQ ID NO: 125730 - DNA, 30 bp, Homo sapiens; identical to SEQ ID NO: 95266
  misc_feature 1..30: note = chr6:20057944-20057974
  misc_feature 1..30: note = Hypo
  source 1..30: mol_type = genomic DNA

SEQ ID NO: 125731 - DNA, 30 bp, Homo sapiens; identical to SEQ ID NO: 95267
  misc_feature 1..30: note = chr6:20317888-20317918
  misc_feature 1..30: note = Hypo
  source 1..30: mol_type = genomic DNA

SEQ ID NO: 125732 - DNA, 30 bp, Homo sapiens; identical to SEQ ID NO: 40761
  misc_feature 1..30: note = chr6:20691518-20691548
  misc_feature 1..30: note = Hypo
  source 1..30: mol_type = genomic DNA

SEQ ID NO: 125733 - DNA, 95 bp, Homo sapiens; identical to SEQ ID NO: 95269
  misc_feature 1..95: note = chr6:20702857-20702952
  misc_feature 1..95: note = Hypo
  source 1..95: mol_type = genomic DNA

SEQ ID NO: 125734 - DNA, 173 bp, Homo sapiens; identical to SEQ ID NO: 95270
  misc_feature 1..173: note = chr6:21587469-21587642
  misc_feature 1..173: note = Hyper
  source 1..173: mol_type = genomic DNA

SEQ ID NO: 125735 - DNA, 268 bp, Homo sapiens; identical to SEQ ID NO: 95271
  misc_feature 1..268: note = chr6:21664923-21665191
  misc_feature 1..268: note = Hyper
  source 1..268: mol_type = genomic DNA

SEQ ID NO: 125736 - DNA, 567 bp, Homo sapiens; identical to SEQ ID NO: 95272
  misc_feature 1..567: note = chr6:21665622-21666189
  misc_feature 1..567: note = Hyper
  source 1..567: mol_type = genomic DNA

SEQ ID NO: 125737 - DNA, 131 bp, Homo sapiens; identical to SEQ ID NO: 95273
  misc_feature 1..131: note = chr6:21666457-21666588
  misc_feature 1..131: note = Hyper
  source 1..131: mol_type = genomic DNA

SEQ ID NO: 125738 - DNA, 23 bp, Homo sapiens
  misc_feature 1..23: note = chr6:21687659-21687682
  misc_feature 1..23: note = Hypo
  source 1..23: mol_type = genomic DNA
tgagactccgcctcaaaacaaaa

SEQ ID NO: 125739 - DNA, 30 bp, Homo sapiens; identical to SEQ ID NO: 95275
  misc_feature 1..30: note = chr6:21782706-21782736
  misc_feature 1..30: note = Hypo
  source 1..30: mol_type = genomic DNA

SEQ ID NO: 125740 - DNA, 176 bp, Homo sapiens; identical to SEQ ID NO: 95276
  misc_feature 1..176: note = chr6:22149842-22150018
  misc_feature 1..176: note = Hypo
  source 1..176: mol_type = genomic DNA

SEQ ID NO: 125741 - DNA, 180 bp, Homo sapiens; identical to SEQ ID NO: 95280
  misc_feature 1..180: note = chr6:24126308-24126488
  misc_feature 1..180: note = Hyper
  source 1..180: mol_type = genomic DNA

SEQ ID NO: 125742 - DNA, 30 bp, Homo sapiens; identical to SEQ ID NO: 95281
  misc_feature 1..30: note = chr6:24438527-24438557
  misc_feature 1..30: note = Hypo
  source 1..30: mol_type = genomic DNA

SEQ ID NO: 125743 - DNA, 30 bp, Homo sapiens; identical to SEQ ID NO: 40764
  misc_feature 1..30: note = chr6:24465059-24465089
  misc_feature 1..30: note = Hypo
  source 1..30: mol_type = genomic DNA

SEQ ID NO: 125744 - DNA, 223 bp, Homo sapiens; identical to SEQ ID NO: 95283
  misc_feature 1..223: note = chr6:24494649-24494872
  misc_feature 1..223: note = Hyper
  source 1..223: mol_type = genomic DNA

SEQ ID NO: 125745 - DNA, 30 bp, Homo sapiens; identical to SEQ ID NO: 95285
  misc_feature 1..30: note = chr6:24546740-24546770
  misc_feature 1..30: note = Hypo
  source 1..30: mol_type = genomic DNA

SEQ ID NO: 125746 - DNA, 30 bp, Homo sapiens; identical to SEQ ID NO: 95286
  misc_feature 1..30: note = chr6:24602615-24602645
  misc_feature 1..30: note = Hypo
  source 1..30: mol_type = genomic DNA

SEQ ID NO: 125747 - DNA, 29 bp, Homo sapiens
  misc_feature 1..29: note = chr6:24647342-24647371
  misc_feature 1..29: note = Hypo
  source 1..29: mol_type = genomic DNA
aaaaccagctgggtgcggtggctcacgcc

SEQ ID NO: 125748 - DNA, 110 bp, Homo sapiens; identical to SEQ ID NO: 95288
  misc_feature 1..110: note = chr6:24761445-24761555
  misc_feature 1..110: note = Hypo
  source 1..110: mol_type = genomic DNA

SEQ ID NO: 125749 - DNA, 150 bp, Homo sapiens; identical to SEQ ID NO: 95290
  misc_feature 1..150: note = chr6:25218431-25218581
  misc_feature 1..150: note = Hypo
  source 1..150: mol_type = genomic DNA

SEQ ID NO: 125750 - DNA, 19 bp, Homo sapiens
  misc_feature 1..19: note = chr6:25311446-25311465
  misc_feature 1..19: note = Hypo
  source 1..19: mol_type = genomic DNA
tgaacgcataagtaccttt

SEQ ID NO: 125751 - DNA, 126 bp, Homo sapiens; identical to SEQ ID NO: 95292
  misc_feature 1..126: note = chr6:25652379-25652505
  misc_feature 1..126: note = Hyper
  source 1..126: mol_type = genomic DNA

SEQ ID NO: 125752 - DNA, 103 bp, Homo sapiens; identical to SEQ ID NO: 95293
  misc_feature 1..103: note = chr6:25668982-25669085
  misc_feature 1..103: note = Hypo
  source 1..103: mol_type = genomic DNA

SEQ ID NO: 125753 - DNA, 30 bp, Homo sapiens; identical to SEQ ID NO: 40768
  misc_feature 1..30: note = chr6:25710967-25710997
  misc_feature 1..30: note = Hypo
  source 1..30: mol_type = genomic DNA

SEQ ID NO: 125754 - DNA, 116 bp, Homo sapiens; identical to SEQ ID NO: 95295
  misc_feature 1..116: note = chr6:25727275-25727391
  misc_feature 1..116: note = Hypo
  source 1..116: mol_type = genomic DNA

SEQ ID NO: 125755 - DNA, 146 bp, Homo sapiens; identical to SEQ ID NO: 95296
  misc_feature 1..146: note = chr6:25727916-25728062
  misc_feature 1..146: note = Hypo
  source 1..146: mol_type = genomic DNA

SEQ ID NO: 125756 - DNA, 30 bp, Homo sapiens; identical to SEQ ID NO: 95297
  misc_feature 1..30: note = chr6:26018763-26018793
  misc_feature 1..30: note = Hypo
  source 1..30: mol_type = genomic DNA

SEQ ID NO: 125757 - DNA, 384 bp, Homo sapiens; identical to SEQ ID NO: 95298
  misc_feature 1..384: note = chr6:26020891-26021275
  misc_feature 1..384: note = Hyper
  source 1..384: mol_type = genomic DNA

SEQ ID NO: 125758 - DNA, 472 bp, Homo sapiens; identical to SEQ ID NO: 95299
  misc_feature 1..472: note = chr6:26021706-26022178
  misc_feature 1..472: note = Hyper
  source 1..472: mol_type = genomic DNA

SEQ ID NO: 125759 - DNA, 30 bp, Homo sapiens; identical to SEQ ID NO: 95300
  misc_feature 1..30: note = chr6:26028765-26028795
  misc_feature 1..30: note = Hypo
  source 1..30: mol_type = genomic DNA

SEQ ID NO: 125760 - DNA, 464 bp, Homo sapiens; identical to SEQ ID NO: 95301
  misc_feature 1..464: note = chr6:26033744-26034208
  misc_feature 1..464: note = Hyper
  source 1..464: mol_type = genomic DNA

SEQ ID NO: 125761 - DNA, 30 bp, Homo sapiens; identical to SEQ ID NO: 95302
  misc_feature 1..30: note = chr6:26034546-26034576
  misc_feature 1..30: note = Hyper
  source 1..30: mol_type = genomic DNA

SEQ ID NO: 125762 - DNA, 41 bp, Homo sapiens; identical to SEQ ID NO: 95303
  misc_feature 1..41: note = chr6:26047700-26047741
  misc_feature 1..41: note = Hypo
  source 1..41: mol_type = genomic DNA

SEQ ID NO: 125763 - DNA, 27 bp, Homo sapiens
  misc_feature 1..27: note = chr6:26053446-26053473
  misc_feature 1..27: note = Hypo
  source 1..27: mol_type = genomic DNA
cgtgagccaccgcgcccagcctttttt

SEQ ID NO: 125764 - DNA, 43 bp, Homo sapiens; identical to SEQ ID NO: 95305
  misc_feature 1..43: note = chr6:26067205-26067248
  misc_feature 1..43: note = Hypo
  source 1..43: mol_type = genomic DNA

SEQ ID NO: 125765 - DNA, 370 bp, Homo sapiens
  misc_feature 1..370: note = chr6:26087615-26087985
  misc_feature 1..370: note = Hyper
  source 1..370: mol_type = genomic DNA
gccccccaaaagaagcggagatttaacggggacgtgcggccagagctggggaaatgggcccgcgagccaggccggcgcttctcctcctgatgcttttgcagaccgcggtcctgcaggggcgcttgctgcgtgagtccgagggctgcgggcgaactaggggcgcggcgggggtggaaaaatcgaaactagctttttctttgcgcttgggagtttgctaactttggaggacctgctcaaccctatccgcaagcccctctccctactttctgcgtccagaccccgtgagggagtgcctaccactgaactgcagataggggtccctcgccccaggacctgccccctcccccggctgtcccggctctgcggagtg

SEQ ID NO: 125766 - DNA, 88 bp, Homo sapiens; identical to SEQ ID NO: 30339
  misc_feature 1..88: note = chr6:26088186-26088274
  misc_feature 1..88: note = Hyper
  source 1..88: mol_type = genomic DNA

SEQ ID NO: 125767 - DNA, 353 bp, Homo sapiens
  misc_feature 1..353: note = chr6:26172018-26172371
  misc_feature 1..353: note = Hyper
  source 1..353: mol_type = genomic DNA
cctgaaaaataacagcggtcatcctactcccggtgcggctatgcggccatgaaaaggagtcttggggccggtcgtgcccctccacgcaggctccctcatagggtcatcccatcaaccctcgccaaaaacgccggccccctcatagggccgtccggccacgcccctccgtgccctaaccacagagccacacgttacgccgccgccccgttacgcccatccggctcccgcatagggcgtcacgtacgtttaacgtcggcccggcgcgcgcgtccgggaggttgcccgtaggccgctaactggtggttcccagtccccgccgactcggcctctttcttctgcggccaccagatcgc

SEQ ID NO: 125768 - DNA, 95 bp, Homo sapiens; identical to SEQ ID NO: 95311
  misc_feature 1..95: note = chr6:26184021-26184116
  misc_feature 1..95: note = Hyper
  source 1..95: mol_type = genomic DNA

SEQ ID NO: 125769 - DNA, 35 bp, Homo sapiens; identical to SEQ ID NO: 95312
  misc_feature 1..35: note = chr6:26184356-26184391
  misc_feature 1..35: note = Hyper
  source 1..35: mol_type = genomic DNA

SEQ ID NO: 125770 - DNA, 691 bp, Homo sapiens
  misc_feature 1..691: note = chr6:26188753-26189444
  misc_feature 1..691: note = Hyper
  source 1..691: mol_type = genomic DNA
cgccattgattactccagcatgggcgacacagcaagagtgaaaataaactttaatacactatcctcaccggccagtaagatatgaagccaaggcgtaataagaccatttaacttgaaaaccggagctactaaacacgtgaaactacacttttagcagtgactactactctttctcctgagtggataggtggccctgaaaagggccgttggttttgcggtagtgtactgtagaggtaagctcagccgccgaagccataaagagtgcgtccctggcgcttgagcgcgtacaccacgtccatggctgtgactgtcttgcgtttggcgtgttccgtgtaggtgacagcatcgcggattacattttccaggaaaactttcagcactccgcgagtttcctcataaatgaggccagaaatacgcttgacgccgccgcggcgagccaggcggcggatagcgggcttggtgattccttggatattgtcacgcaataccttacggtgacgcttggcgccacccttacctagaccctttccgcccttaccgcggccagacatcttgaaaccacagctgttaaatctgtaacgcaatacgtctggcagagccacgcagcacttttataatagcatgacggacctgtttgaaaacctcatgagaaggggcgggaaccacagtcagttcccgcccttctgtgcaa

SEQ ID NO: 125771 - DNA, 36 bp, Homo sapiens
  misc_feature 1..36: note = chr6:26189955-26189991
  misc_feature 1..36: note = Hypo
  source 1..36: mol_type = genomic DNA
tacaggcgtgagccaccgcgccgggccataaggtgc

SEQ ID NO: 125772 - DNA, 248 bp, Homo sapiens; identical to SEQ ID NO: 95315
  misc_feature 1..248: note = chr6:26197272-26197520
  misc_feature 1..248: note = Hyper
  source 1..248: mol_type = genomic DNA

SEQ ID NO: 125773 - DNA, 25 bp, Homo sapiens
  misc_feature 1..25: note = chr6:26198574-26198599
  misc_feature 1..25: note = Hyper
  source 1..25: mol_type = genomic DNA
gttttgagacagtctcgctctgtcg

SEQ ID NO: 125774 - DNA, 85 bp, Homo sapiens; identical to SEQ ID NO: 30346
  misc_feature 1..85: note = chr6:26198839-26198924
  misc_feature 1..85: note = Hyper
  source 1..85: mol_type = genomic DNA

SEQ ID NO: 125775 - DNA, 696 bp, Homo sapiens; identical to SEQ ID NO: 95318
  misc_feature 1..696: note = chr6:26199182-26199878
  misc_feature 1..696: note = Hyper
  source 1..696: mol_type = genomic DNA

SEQ ID NO: 125776 - DNA, 36 bp, Homo sapiens; identical to SEQ ID NO: 95319
  misc_feature 1..36: note = chr6:26200118-26200154
  misc_feature 1..36: note = Hyper
  source 1..36: mol_type = genomic DNA

SEQ ID NO: 125777 - DNA, 613 bp, Homo sapiens; identical to SEQ ID NO: 30350
  misc_feature 1..613: note = chr6:26204685-26205298
  misc_feature 1..613: note = Hyper
  source 1..613: mol_type = genomic DNA

SEQ ID NO: 125778 - DNA, 210 bp, Homo sapiens; identical to SEQ ID NO: 30351
  misc_feature 1..210: note = chr6:26205502-26205712
  misc_feature 1..210: note = Hyper
  source 1..210: mol_type = genomic DNA

SEQ ID NO: 125779 - DNA, 36 bp, Homo sapiens; identical to SEQ ID NO: 40772
  misc_feature 1..36: note = chr6:26214612-26214648
  misc_feature 1..36: note = Hypo
  source 1..36: mol_type = genomic DNA

SEQ ID NO: 125780 - DNA, 223 bp, Homo sapiens; identical to SEQ ID NO: 95323
  misc_feature 1..223: note = chr6:26216047-26216270
  misc_feature 1..223: note = Hyper
  source 1..223: mol_type = genomic DNA

SEQ ID NO: 125781 - DNA, 300 bp, Homo sapiens; identical to SEQ ID NO: 95324
  misc_feature 1..300: note = chr6:26216390-26216690
  misc_feature 1..300: note = Hyper
  source 1..300: mol_type = genomic DNA

SEQ ID NO: 125782 - DNA, 43 bp, Homo sapiens; identical to SEQ ID NO: 95325
  misc_feature 1..43: note = chr6:26216810-26216853
  misc_feature 1..43: note = Hyper
  source 1..43: mol_type = genomic DNA

SEQ ID NO: 125783 - DNA, 80 bp, Homo sapiens; identical to SEQ ID NO: 95326
  misc_feature 1..80: note = chr6:26217076-26217156
  misc_feature 1..80: note = Hyper
  source 1..80: mol_type = genomic DNA

SEQ ID NO: 125784 - DNA, 213 bp, Homo sapiens; identical to SEQ ID NO: 95327
  misc_feature 1..213: note = chr6:26217365-26217578
  misc_feature 1..213: note = Hyper
  source 1..213: mol_type = genomic DNA

SEQ ID NO: 125785 - DNA, 39 bp, Homo sapiens; identical to SEQ ID NO: 95328
  misc_feature 1..39: note = chr6:26226763-26226802
  misc_feature 1..39: note = Hypo
  source 1..39: mol_type = genomic DNA

SEQ ID NO: 125786 - DNA, 1358 bp, Homo sapiens; identical to SEQ ID NO: 95329
  misc_feature 1..1358: note = chr6:26233978-26235336
  misc_feature 1..1358: note = Hyper
  source 1..1358: mol_type = genomic DNA

SEQ ID NO: 125787 - DNA, 636 bp, Homo sapiens; identical to SEQ ID NO: 95330
  misc_feature 1..636: note = chr6:26240633-26241269
  misc_feature 1..636: note = Hyper
  source 1..636: mol_type = genomic DNA

SEQ ID NO: 125788 - DNA, 41 bp, Homo sapiens; identical to SEQ ID NO: 30359
  misc_feature 1..41: note = chr6:26249960-26250001
  misc_feature 1..41: note = Hyper
  source 1..41: mol_type = genomic DNA

SEQ ID NO: 125789 - DNA, 1001 bp, Homo sapiens
  misc_feature 1..1001: note = chr6:26250181-26251182
  misc_feature 1..1001: note = Hyper
  source 1..1001: mol_type = genomic DNA
cgggctcccacagtactgggattacaaggcgtgagccgccactatcggccattttgaagacaatggccaagacacaaaagcctagtttagaagagccaccggccctgcccccatcccctaaccctccaccctccttgttttaggagacattactccctagtgctacggcgctttcaactgaaattgttggtggctctgaaaagagcctttggtttaagttggcgcacaccctcagtacaacttatgccctctctccgcgaatgcggcgagcgagctggatgtccttgggcatgatagtcactcgcttggcgtggatagcacacaggttggtgtcctcaaagagccccaccaggtaagcctcgcaggcctcctgcagcgccatcacagccgagctctggaagcgcaggtcggtcttgaagtcctgcgcgatctcacgtaccagacgctggaatggtagcttgcgaatcagtagctcagtcgatttctgatagcggcggatttcacggagggcgacagtaccaggcctgtagcggtggggcttcttcacgccaccggtggctggcgcgcttttgcgagccgccttagtggccagctgcttgcgcggggctttgccgccagtggacttacgagctgtttgcttcgtgcgtgccataggaatgggtttcaagcaatggtcacaactgaacaaacagttgttcttactcctatttataaaggcaaagtccttctgattggtccgaatcttccagtttcgcgccctgaattatgtagtgtgataggacttgtgatcagctactaggtctcattttagaaaatcttaacctatctaaatgcttttttcccctagttccttacattttattatgttttatgtgcctacctgtattacgtaccttcattgattttattttaatcagtttgtttgggattatgtttgacagacggaaatgaacgttctgcagttccggagcgattcaaaaataccgcgtttgagagtgatt

SEQ ID NO: 125790 - DNA, 400 bp, Homo sapiens; identical to SEQ ID NO: 30362
  misc_feature 1..400: note = chr6:26251540-26251940
  misc_feature 1..400: note = Hyper
  source 1..400: mol_type = genomic DNA

SEQ ID NO: 125791 - DNA, 120 bp, Homo sapiens
  misc_feature 1..120: note = chr6:26252060-26252180
  misc_feature 1..120: note = Hyper
  source 1..120: mol_type = genomic DNA
gatcatgaattcctttgtcaacgatatcttcgagcgcatcgccggcgaggcttcccgcctggctcattacaacaagcgttcgaccatcacctccagggagatccagacagccgtgcgcct

SEQ ID NO: 125792 - DNA, 39 bp, Homo sapiens; identical to SEQ ID NO: 30365
  misc_feature 1..39: note = chr6:26252240-26252279
  misc_feature 1..39: note = Hyper
  source 1..39: mol_type = genomic DNA

SEQ ID NO: 125793 - DNA, 759 bp, Homo sapiens
  misc_feature 1..759: note = chr6:26271346-26272105
  misc_feature 1..759: note = Hyper
  source 1..759: mol_type = genomic DNA
gcggaactctgaaagcgcagatctgtcttgaagtcctgagcgatttctcgcaccaggcgttggaaaggcaacttgcggatcagcagctcagtcgacttctgatagcggcgaatctcgcgcagagccacggtgccgggacggtagcgatgaggtttcttcacgccgccggtggccggcgcgcttttccgagccgccttagtggccagctgcttgcgcggcgctttgccaccggtggacttgcgtgcagtctgcttggtgcgggccatctcagactacctgaaagaaaaactcagccacttggcagagtggaaactgcccttatatatactcagaaacattctaattggccttgttgattttcaaaagacccgcgcaacaaaaccattggctgaagagtccaacgatgtgattggtgaattactggaaaatctgattggatgaatcacttcatttttgaatcctctcttctcggttagtctgcgatccaagaacgttaacttcttaaagttctaattctgcgcttctcaagctgtagtccgtaaacgactactttaagacttggaagacgctaattctcattcagtagatgtgttgtggggccagattcggaggaccacgttttgagaagtttatcttgtgccgttttcttgagtcacctggactgctgctagctggaaacctttgaccattataaggcaggattcctgggtgatgtacctgggaaatcacgagccaagaagtcaccgacatacaacagtg

SEQ ID NO: 125794 - DNA, 422 bp, Homo sapiens; identical to SEQ ID NO: 30369
  misc_feature 1..422: note = chr6:26272431-26272853
  misc_feature 1..422: note = Hyper
  source 1..422: mol_type = genomic DNA

SEQ ID NO: 125795 - DNA, 205 bp, Homo sapiens; identical to SEQ ID NO: 95341
  misc_feature 1..205: note = chr6:26273080-26273285
  misc_feature 1..205: note = Hyper
  source 1..205: mol_type = genomic DNA

SEQ ID NO: 125796 - DNA, 420 bp, Homo sapiens
  misc_feature 1..420: note = chr6:26273345-26273765
  misc_feature 1..420: note = Hyper
  source 1..420: mol_type = genomic DNA
aggtccaccccgacaccggcatctcgtccaaggctatggggattatgaactccttcgtcaacgacattttcgagcgcattgcaggcgaggcttcccgcctggcgcattataacaagcgctcgaccatcacttccagggagatccaaacggctgtgcgcctgctgctacccggggagctggccaaacacgcggtgtcggagggcaccaaggcggtcaccaagtacaccagctccaagtaaactagttacctgggtaaaagcgctaacgacccaaaggctcttctaagagccacccatgttgtcatttaaagatctgtaattttccagacttggcattggcaaggtaaaatggctaagcaacacatgggatagtaagggtttactgaaacatccaagttcggccgggcgcagtggctcacgc

SEQ ID NO: 125797 - DNA, 89 bp, Homo sapiens; identical to SEQ ID NO: 95344
  misc_feature 1..89: note = chr6:26283423-26283512
  misc_feature 1..89: note = Hypo
  source 1..89: mol_type = genomic DNA

SEQ ID NO: 125798 - DNA, 49 bp, Homo sapiens; identical to SEQ ID NO: 95345
  misc_feature 1..49: note = chr6:26284880-26284929
  misc_feature 1..49: note = Hyper
  source 1..49: mol_type = genomic DNA

SEQ ID NO: 125799 - DNA, 30 bp, Homo sapiens; identical to SEQ ID NO: 95346
  misc_feature 1..30: note = chr6:26313515-26313545
  misc_feature 1..30: note = Hyper
  source 1..30: mol_type = genomic DNA

SEQ ID NO: 125800 - DNA, 120 bp, Homo sapiens; identical to SEQ ID NO: 30372
  misc_feature 1..120: note = chr6:26322568-26322688
  misc_feature 1..120: note = Hyper
  source 1..120: mol_type = genomic DNA

SEQ ID NO: 125801 - DNA, 157 bp, Homo sapiens; identical to SEQ ID NO: 537
  misc_feature 1..157: note = chr6:26327825-26327982
  misc_feature 1..157: note = Hyper
  source 1..157: mol_type = genomic DNA

SEQ ID NO: 125802 - DNA, 122 bp, Homo sapiens; identical to SEQ ID NO: 95349
  misc_feature 1..122: note = chr6:26328294-26328416
  misc_feature 1..122: note = Hyper
  source 1..122: mol_type = genomic DNA

SEQ ID NO: 125803 - DNA, 108 bp, Homo sapiens; identical to SEQ ID NO: 30375
  misc_feature 1..108: note = chr6:26331703-26331811
  misc_feature 1..108: note = Hyper
  source 1..108: mol_type = genomic DNA

SEQ ID NO: 125804 - DNA, 149 bp, Homo sapiens; identical to SEQ ID NO: 95351
  misc_feature 1..149: note = chr6:26332134-26332283
  misc_feature 1..149: note = Hyper
  source 1..149: mol_type = genomic DNA

SEQ ID NO: 125805 - DNA, 487 bp, Homo sapiens
  misc_feature 1..487: note = chr6:26501722-26502209
  misc_feature 1..487: note = Hyper
  source 1..487: mol_type = genomic DNA
gagcgcggggcactgcgctttggcgggaatctggtcggtgtctgtccgtagttcccatctccacatcccgtctgatcccgctcgtttttcggcagctccctttgacgtgattggacccccggagcccatcctggccgttgtgggtgaggacgccgagctgccctgtcgcctgtctccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctggtgagtagacgggttttgactttctccgacgactcccctgctgt

SEQ ID NO: 125806 - DNA, 77 bp, Homo sapiens; identical to SEQ ID NO: 95354
  misc_feature 1..77: note = chr6:26534344-26534421
  misc_feature 1..77: note = Hypo
  source 1..77: mol_type = genomic DNA

SEQ ID NO: 125807 - DNA, 362 bp, Homo sapiens
  misc_feature 1..362: note = chr6:26550767-26551129
  misc_feature 1..362: note = Hyper
  source 1..362: mol_type = genomic DNA
atggcctggaagagccgtactctggatacccgagggcgcggccccagcgccgcgacgccccgcccctctggctgctccgctctgggatgcacttccgacgccctctaggcttgggagttccgcgcctctcggtgtcgcctggggggcgtgctccggttggcgcactgattcccagttgggtaggggaggcttgactgagctcccacccggaatttcaccttagacctttaaagaccttgctccggcctcccgcgccagcgctaacacctagtcctctttagtggagttccggcggaaggggatggcgggcacccgacggtggtctcctcccagatggcgaatttccgcggcttcttcatctt

SEQ ID NO: 125808 - DNA, 91 bp, Homo sapiens; identical to SEQ ID NO: 95357
  misc_feature 1..91: note = chr6:26555188-26555279
  misc_feature 1..91: note = Hyper
  source 1..91: mol_type = genomic DNA

SEQ ID NO: 125809 - DNA, 344 bp, Homo sapiens; identical to SEQ ID NO: 95358
  misc_feature 1..344: note = chr6:26577131-26577475
  misc_feature 1..344: note = Hyper
  source 1..344: mol_type = genomic DNA

SEQ ID NO: 125810 - DNA, 168 bp, Homo sapiens; identical to SEQ ID NO: 95359
  misc_feature 1..168: note = chr6:26577722-26577890
  misc_feature 1..168: note = Hyper
  source 1..168: mol_type = genomic DNA

SEQ ID NO: 125811 - DNA, 41 bp, Homo sapiens; identical to SEQ ID NO: 95361
  misc_feature 1..41: note = chr6:26988028-26988069
  misc_feature 1..41: note = Hyper
  source 1..41: mol_type = genomic DNA

SEQ ID NO: 125812 - DNA, 213 bp, Homo sapiens; identical to SEQ ID NO: 30382
  misc_feature 1..213: note = chr6:27059686-27059899
  misc_feature 1..213: note = Hyper
  source 1..213: mol_type = genomic DNA

SEQ ID NO: 125813 - DNA, 688 bp, Homo sapiens
  misc_feature 1..688: note = chr6:27064628-27065316
  misc_feature 1..688: note = Hyper
  source 1..688: mol_type = genomic DNA
cgactccggtgtgaacggttttgggaacctcggtctcctgctggctcccaggtgcgctatccgacgcagcgagacgcggtgagcctacagaagggctgaccaggctcacctgacgccccaggtcgacagcaaaccccgtgcgccccgttggcccggtcacgcccgcagcctgctcaggcgcctcctgcctcgggaccaggaagcggaagaaagggagagaccggcccggcaattacgtttctatcatgtcttgaacatttgtgtgagtcccacgaaagctaagcccgtttattccccctcgaagcgtttccactcagttcttgatcattcatgtgaaaacgagccatctccacgtctcccaaacgtcttcaaaccgtttcctaagtcttgtaaggccgcctgtgggttcctattacaaactctgaaataaaatactcgggaaacgtgggttatcaagacgaggtggccgagtggttaaggcgatggactgctaatccattgtgctctgcacgcgtgggttcgaatcccaccctcgtcgggggaggtcttttaatacgaagaggaggaaacaacacccaagtccagccaacttccctttcaactctcctggaattcaggtccctggcgttggagaggaaaaaggagctcttgtaattttgtatcatcagtataacgatggtgttgctgg

SEQ ID NO: 125814 - DNA, 299 bp, Homo sapiens
  misc_feature 1..299: note = chr6:27094912-27095211
  misc_feature 1..299: note = Hyper
  source 1..299: mol_type = genomic DNA
ctacattagcctatccgttattgccataagatggcgacagcccttctcaactcataaaactaaacaaagttttagctacattatcccatccattatcgccacaagatggcgatagcgcttctcaactcgcctgcgggacggaggcagggtgcggcccggagaactcctccctgttccaacagcagctctccagcccgcagcgcttcctgacgttccgttagttcagtctcctgaacttctctgcatgtagattcctctcagggtagccctttgttgaccaaaaacgaaatatgttcact

SEQ ID NO: 125815 - DNA, 110 bp, Homo sapiens; identical to SEQ ID NO: 95369
  misc_feature 1..110: note = chr6:27099764-27099874
  misc_feature 1..110: note = Hyper
  source 1..110: mol_type = genomic DNA

SEQ ID NO: 125816 - DNA, 98 bp, Homo sapiens; identical to SEQ ID NO: 95370
  misc_feature 1..98: note = chr6:27100291-27100389
  misc_feature 1..98: note = Hyper
  source 1..98: mol_type = genomic DNA

SEQ ID NO: 125817 - DNA, 600 bp, Homo sapiens; identical to SEQ ID NO: 95371
  misc_feature 1..600: note = chr6:27100449-27101049
  misc_feature 1..600: note = Hyper
  source 1..600: mol_type = genomic DNA

SEQ ID NO: 125818 - DNA, 97 bp, Homo sapiens; identical to SEQ ID NO: 95372
  misc_feature 1..97: note = chr6:27101109-27101206
  misc_feature 1..97: note = Hyper
  source 1..97: mol_type = genomic DNA

SEQ ID NO: 125819 - DNA, 24 bp, Homo sapiens
  misc_feature 1..24: note = chr6:27102706-27102730
  misc_feature 1..24: note = Hypo
  source 1..24: mol_type = genomic DNA
ttaagaagacgttaactcattttt

SEQ ID NO: 125820 - DNA, 498 bp, Homo sapiens
  misc_feature 1..498: note = chr6:27173366-27173864
  misc_feature 1..498: note = Hyper
  source 1..498: mol_type = genomic DNA
ttcttgttacctgcccgaggtccttgtcagttcttaaggacaggtgctttgcattatcctccagcactctcccacccactgcaacattcccctctcaccatgcaggtggtaagtaaattttggttgaaaatatttatccagcaagagatgaattgcccggctaatgtcactgccggacgcccgggtagtcgccacttggtttaaaggcggagctgttcttgcatttcaaagaaatccagattccgaaagtaagtaacaaccatgcccgtggcccggttcctttctcttacactcttccaaggaccccttttagacctagaggaaaccccgcagaagtgacagggagagggggaaagctcttttacagtggcgaaaccacgtggctgcgagagcttctcagggagagctcctgttttcaaagtctggcaaatttatcagtttgatttttcttaaacatttatatttttatggagtagaaaatctaccaaacgagtaaag

SEQ ID NO: 125821 - DNA, 257 bp, Homo sapiens; identical to SEQ ID NO: 95376
  misc_feature 1..257: note = chr6:27173924-27174181
  misc_feature 1..257: note = Hyper
  source 1..257: mol_type = genomic DNA

SEQ ID NO: 125822 - DNA, 145 bp, Homo sapiens; identical to SEQ ID NO: 95377
  misc_feature 1..145: note = chr6:27182855-27183000
  misc_feature 1..145: note = Hyper
  source 1..145: mol_type = genomic DNA

SEQ ID NO: 125823 - DNA, 86 bp, Homo sapiens; identical to SEQ ID NO: 95378
  misc_feature 1..86: note = chr6:27203207-27203293
  misc_feature 1..86: note = Hyper
  source 1..86: mol_type = genomic DNA

SEQ ID NO: 125824 - DNA, 27 bp, Homo sapiens
  misc_feature 1..27: note = chr6:27205332-27205359
  misc_feature 1..27: note = Hyper
  source 1..27: mol_type = genomic DNA
gaaggtgagaaccctcgtggcccgtac

SEQ ID NO: 125825 - DNA, 867 bp, Homo sapiens
  misc_feature 1..867: note = chr6:27205419-27206286
  misc_feature 1..867: note = Hyper
  source 1..867: mol_type = genomic DNA
ggccacccggaaaacagttgttctttcaattttaaaaaagcaaaatgtttgttgtttttgtgtttctttaacactaaaggaaattcttttcctctcctcaaagggatgtcttttaaaataattttaattgcgactacgtaatattgtttcttcaaacttctgttggtgttttgcattttcccttcctgcactcccgcagggaagaaggaaaacaaaaacaaaaacaaggacaaggccaaaaactctacctccagcagaaaggaacttcgcctctcccgtgggaaatgagattttctcaaactcacctattccgcccggagaaaatactacagagaaccattcacgagaggggcttccttccttttgaccttgggaggggtccagagacccgggggacgatctgggagcagaagctggtcgttctgagttttccatccaaatggtttgcttatgaaattgactcaccacgcggaatggctggtggatttggatcgcggcatgaggaatccgctccataatggaaggaagaaaatctccggcagctatgcctcgcgggttcataaggactggagagttactccttctctctggccccctcaaaacgcccggtggtatgtctgttgctccactacgcgttattataattaactgcttgtgttactctttgtgctgtcttgctcttcattctcctggtacctcgggtgcccgcacagcatggtaagctgctcaatagttcaatgaatggggaaaaggtgtgcagaggtcatttctgctgattatcaagacttcaattcttcgaagtggagcacgaggatcctctaggcggcaggcaaatgtcatcaggagtctcaacgtcttccccccaaa

SEQ ID NO: 125826 - DNA, 58 bp, Homo sapiens
  misc_feature 1..58: note = chr6:27206493-27206551
  misc_feature 1..58: note = Hyper
  source 1..58: mol_type = genomic DNA
gtccgggcgcggctacggttcctggtacacattcgctgcgcctcgggcagcctaaggg

SEQ ID NO: 125827 - DNA, 61 bp, Homo sapiens; identical to SEQ ID NO: 95384
  misc_feature 1..61: note = chr6:27219595-27219656
  misc_feature 1..61: note = Hyper
  source 1..61: mol_type = genomic DNA

SEQ ID NO: 125828 - DNA, 287 bp, Homo sapiens
  misc_feature 1..287: note = chr6:27228172-27228459
  misc_feature 1..287: note = Hyper
  source 1..287: mol_type = genomic DNA
gaagagcccacctgccgggcgagcgtctccaagagtgaaaaggaatccgcaccccgcgcgagggagccgggtcctgtgaactctgcggtggcttcgtggttgcttccctgatccattcgctgcagtctcagagttggagcagcttggcgtttactcccgggcctttcccggatgggagaaggaacctgcgcgggaacttgaattttttcgagtcagaatcagcaagttgttgttgtttgagaccaagtgagccaccgcacccagccaagaatcggctgtttaagaaa

SEQ ID NO: 125829 - DNA, 280 bp, Homo sapiens; identical to SEQ ID NO: 95387
  misc_feature 1..280: note = chr6:27228667-27228947
  misc_feature 1..280: note = Hyper
  source 1..280: mol_type = genomic DNA

SEQ ID NO: 125830 - DNA, 245 bp, Homo sapiens; identical to SEQ ID NO: 95388
  misc_feature 1..245: note = chr6:27242878-27243123
  misc_feature 1..245: note = Hyper
  source 1..245: mol_type = genomic DNA

SEQ ID NO: 125831 - DNA, 522 bp, Homo sapiens; identical to SEQ ID NO: 95389
  misc_feature 1..522: note = chr6:27247546-27248068
  misc_feature 1..522: note = Hyper
  source 1..522: mol_type = genomic DNA

SEQ ID NO: 125832 - DNA, 24 bp, Homo sapiens
  misc_feature 1..24: note = chr6:27249182-27249206
  misc_feature 1..24: note = Hyper
  source 1..24: mol_type = genomic DNA
gattgcaggcgtgagcaacggcgc

SEQ ID NO: 125833 - DNA, 510 bp, Homo sapiens; identical to SEQ ID NO: 95391
  misc_feature 1..510: note = chr6:27255937-27256447
  misc_feature 1..510: note = Hyper
  source 1..510: mol_type = genomic DNA

SEQ ID NO: 125834 - DNA, 329 bp, Homo sapiens; identical to SEQ ID NO: 95392
  misc_feature 1..329: note = chr6:27258095-27258424
  misc_feature 1..329: note = Hyper
  source 1..329: mol_type = genomic DNA

SEQ ID NO: 125835 - DNA, 30 bp, Homo sapiens; identical to SEQ ID NO: 95393
  misc_feature 1..30: note = chr6:27264021-27264051
  misc_feature 1..30: note = Hyper
  source 1..30: mol_type = genomic DNA

SEQ ID NO: 125836 - DNA, 30 bp, Homo sapiens; identical to SEQ ID NO: 95394
  misc_feature 1..30: note = chr6:27264418-27264448
  misc_feature 1..30: note = Hyper
  source 1..30: mol_type = genomic DNA

SEQ ID NO: 125837 - DNA, 1007 bp, Homo sapiens; identical to SEQ ID NO: 95395
  misc_feature 1..1007: note = chr6:27279779-27280786
  misc_feature 1..1007: note = Hyper
  source 1..1007: mol_type = genomic DNA

SEQ ID NO: 125838 - DNA, 166 bp, Homo sapiens; identical to SEQ ID NO: 95396
  misc_feature 1..166: note = chr6:27301031-27301197
  misc_feature 1..166: note = Hyper
  source 1..166: mol_type = genomic DNA

SEQ ID NO: 125839 - DNA, 578 bp, Homo sapiens; identical to SEQ ID NO: 95397
  misc_feature 1..578: note = chr6:27342451-27343029
  misc_feature 1..578: note = Hyper
  source 1..578: mol_type = genomic DNA

SEQ ID NO: 125840 - DNA, 30 bp, Homo sapiens; identical to SEQ ID NO: 95398
  misc_feature 1..30: note = chr6:27356433-27356463
  misc_feature 1..30: note = Hyper
  source 1..30: mol_type = genomic DNA

SEQ ID NO: 125841 - DNA, 395 bp, Homo sapiens; identical to SEQ ID NO: 95399
  misc_feature 1..395: note = chr6:27356685-27357080
  misc_feature 1..395: note = Hyper
  source 1..395: mol_type = genomic DNA

SEQ ID NO: 125842 - DNA, 21 bp, Homo sapiens
  misc_feature 1..21: note = chr6:27441925-27441946
  misc_feature 1..21: note = Hypo
  source 1..21: mol_type = genomic DNA
ccactgcgcccggccccaaca

SEQ ID NO: 125843 - DNA, 658 bp, Homo sapiens; identical to SEQ ID NO: 95402
  misc_feature 1..658: note = chr6:27463029-27463687
  misc_feature 1..658: note = Hyper
  source 1..658: mol_type = genomic DNA

SEQ ID NO: 125844 - DNA, 240 bp, Homo sapiens; identical to SEQ ID NO: 95403
  misc_feature 1..240: note = chr6:27471362-27471602
  misc_feature 1..240: note = Hyper
  source 1..240: mol_type = genomic DNA

SEQ ID NO: 125845 - DNA, 30 bp, Homo sapiens; identical to SEQ ID NO: 95404
  misc_feature 1..30: note = chr6:27494670-27494700
  misc_feature 1..30: note = Hypo
  source 1..30: mol_type = genomic DNA

SEQ ID NO: 125846 - DNA, 1314 bp, Homo sapiens
  misc_feature 1..1314: note = chr6:27512392-27513706
  misc_feature 1..1314: note = Hyper
  source 1..1314: mol_type = genomic DNA
tcaaaggttacaaaccgtttctaacctaaattgaagatatagcaaatgccccagtaataagaccaaataatatttgcaagagtccaacgaagggaacacatttcttactattttagagggaaaaacaaatgtgggcgcgctttcactatcagagacattgccggcctcggtcatggaggtcactttccctttgtatctgcggggccgactcacttccattcccagaattccgagactttccccctaacttttgtctaaaaaggaatctgattcaagtctaccccttatttttccactctgacaatactgtagtatctgaagcaagaatcaaccttattaatttagctagatttatcctgacatttacttgtttccatctttttgcgtttttctgtgctggactctccctaagatatttggaaacctgtgttctgagttcttccttttccccgggctcgggtggctgaaggccttggctcttgggaatggtctcgcgtccttcaccagaactgacgggaattatatttacctgaagagtcagagacctcttcagagtcatcttttccagttaggacagaaacaagctccctcctcagctagcacgcccgctccagtccggttttagccgttccttcggaagagtaagtcagttgaatgtcatcgaagaagctcctgatttagattttaactgtacgtaaacgcagatgaccccccactctcgtgccttcatttaattcccgttgcttctcccatgggtattcagaggcttgaggttgcttggactctcaattcaatactccctttctgcgggttcgtgagaattaggtgtgaacgtggtgtccgcggatttcagcagctagcgggcaagctccagcgcccagaaactttgagtcgcttgtctaggagtcctgtgttgaattgcaacactatgcactatgttctggttattgatgtgctctgaatgagctctttcgttcgtgagcagaggccctgacgagactgaagaccaactatttccgagcgctccactcaaccattataagttcaccccagccgtcagcgatggcgtaggtaggtagtcgtggccgagtggttaaggcgatggacttgaaatccattggggtttccccgcgcaggttcgaatcctgccgactacggttttaccaggtgcagttcccgcctttcctcaaaacttacccaaattcttgtactccatttgctgctctcctacacaatcctcccactgcatattcagataatatcctctttactcagtgaatggagactaccttatgttgccgttacttcaaaact

SEQ ID NO: 125847 - DNA, 34 bp, Homo sapiens; identical to SEQ ID NO: 95407
  misc_feature 1..34: note = chr6:27526047-27526081
  misc_feature 1..34: note = Hyper
  source 1..34: mol_type = genomic DNA

SEQ ID NO: 125848 - DNA, 30 bp, Homo sapiens; identical to SEQ ID NO: 95408
  misc_feature 1..30: note = chr6:27526284-27526314
  misc_feature 1..30: note = Hyper
  source 1..30: mol_type = genomic DNA

SEQ ID NO: 125849 - DNA, 604 bp, Homo sapiens; identical to SEQ ID NO: 95409
  misc_feature 1..604: note = chr6:27533773-27534377
  misc_feature 1..604: note = Hyper
  source 1..604: mol_type = genomic DNA

SEQ ID NO: 125850 - DNA, 58 bp, Homo sapiens; identical to SEQ ID NO: 95410
  misc_feature 1..58: note = chr6:27551225-27551283
  misc_feature 1..58: note = Hyper
  source 1..58: mol_type = genomic DNA

SEQ ID NO: 125851 - DNA, 138 bp, Homo sapiens; identical to SEQ ID NO: 95411
  misc_feature 1..138: note = chr6:27559855-27559993
  misc_feature 1..138: note = Hyper
  source 1..138: mol_type = genomic DNA

SEQ ID NO: 125852 - DNA, 34 bp, Homo sapiens; identical to SEQ ID NO: 95412
  misc_feature 1..34: note = chr6:27560276-27560310
  misc_feature 1..34: note = Hyper
  source 1..34: mol_type = genomic DNA

SEQ ID NO: 125853 - DNA, 175 bp, Homo sapiens; identical to SEQ ID NO: 95413
  misc_feature 1..175: note = chr6:27560710-27560885
  misc_feature 1..175: note = Hyper
  source 1..175: mol_type = genomic DNA

SEQ ID NO: 125854 - DNA, 789 bp, Homo sapiens; identical to SEQ ID NO: 95414
  misc_feature 1..789: note = chr6:27572826-27573615
  misc_feature 1..789: note = Hyper
  source 1..789: mol_type = genomic DNA

SEQ ID NO: 125855 - DNA, 379 bp, Homo sapiens; identical to SEQ ID NO: 95415
  misc_feature 1..379: note = chr6:27585093-27585472
  misc_feature 1..379: note = Hyper
  source 1..379: mol_type = genomic DNA

SEQ ID NO: 125856 - DNA, 669 bp, Homo sapiens; identical to SEQ ID NO: 95416
  misc_feature 1..669: note = chr6:27598672-27599341
  misc_feature 1..669: note = Hyper
  source 1..669: mol_type = genomic DNA

SEQ ID NO: 125857 - DNA, 25 bp, Homo sapiens
  misc_feature 1..25: note = chr6:27631920-27631945
  misc_feature 1..25: note = Hypo
  source 1..25: mol_type = genomic DNA
aaaactcaatacttccggccaggcg

SEQ ID NO: 125858 - DNA, 30 bp, Homo sapiens; identical to SEQ ID NO: 95418
  misc_feature 1..30: note = chr6:27633696-27633726
  misc_feature 1..30: note = Hypo
  source 1..30: mol_type = genomic DNA

SEQ ID NO: 125859 - DNA, 258 bp, Homo sapiens; identical to SEQ ID NO: 95419
  misc_feature 1..258: note = chr6:27635245-27635503
  misc_feature 1..258: note = Hyper
  source 1..258: mol_type = genomic DNA

SEQ ID NO: 125860 - DNA, 211 bp, Homo sapiens; identical to SEQ ID NO: 30418
  misc_feature 1..211: note = chr6:27635858-27636069
  misc_feature 1..211: note = Hyper
  source 1..211: mol_type = genomic DNA

SEQ ID NO: 125861 - DNA, 196 bp, Homo sapiens; identical to SEQ ID NO: 95421
  misc_feature 1..196: note = chr6:27636335-27636531
  misc_feature 1..196: note = Hyper
  source 1..196: mol_type = genomic DNA

SEQ ID NO: 125862 - DNA, 262 bp, Homo sapiens; identical to SEQ ID NO: 95422
  misc_feature 1..262: note = chr6:27640050-27640312
  misc_feature 1..262: note = Hyper
  source 1..262: mol_type = genomic DNA

SEQ ID NO: 125863 - DNA, 734 bp, Homo sapiens
  misc_feature 1..734: note = chr6:27647513-27648247
  misc_feature 1..734: note = Hyper
  source 1..734: mol_type = genomic DNA
gggggtaggggttggcgatcgaccatcaggagagcccagtctttgccacttgcggggagtcacttattgcaggcagggtgttaactgagtttaacactaggagacaaaatgaggaaataatctctcagaatgtaggttaggaaagtagaaacgccctccgagtgtatgtctatcccagaagaaaacctgtcttaaagttcgcgatttttaccaaaataggccacgaaacacacaaagtcgctaaactttttaaccctttcctctttttctttcttatttccgagaaatctcgcaaacggcgtgaacactacgctgattccagaaatggtcgggttcccttccttcactcaggatggtcgcctgctgggagctcatttcgaaccgagctgaacgctcattgctgagtcctgggagaaggtcgcgtttgtacagaaggctcctggcagcgagcaaggccgggagtgggcccagtgcgcacgaagtcgcgccccgaattcccactgggaggaacgcactggaattgaaatgtctgagatcaagccccgctgagaatcaagtcccagaggatcttctcggctggtggaaacgtggaggggaaaggcggtcacgaaaattgaagtctcctagtccaatacagattatccaggccgttgacggcaggaatatatttttatttattcctttacccttctctcctcacagctcttccttctcgtccacgcttgatgggtttt

SEQ ID NO: 125864 - DNA, 258 bp, Homo sapiens; identical to SEQ ID NO: 95425
  misc_feature 1..258: note = chr6:27648814-27649072
  misc_feature 1..258: note = Hyper
  source 1..258: mol_type = genomic DNA

SEQ ID NO: 125865 - DNA, 441 bp, Homo sapiens; identical to SEQ ID NO: 95426
  misc_feature 1..441: note = chr6:27661684-27662125
  misc_feature 1..441: note = Hyper
  source 1..441: mol_type = genomic DNA

SEQ ID NO: 125866 - DNA, 34 bp, Homo sapiens; identical to SEQ ID NO: 95427
  misc_feature 1..34: note = chr6:27719759-27719793
  misc_feature 1..34: note = Hypo
  source 1..34: mol_type = genomic DNA

SEQ ID NO: 125867 - DNA, 153 bp, Homo sapiens; identical to SEQ ID NO: 95428
  misc_feature 1..153: note = chr6:27719853-27720006
  misc_feature 1..153: note = Hypo
  source 1..153: mol_type = genomic DNA

SEQ ID NO: 125868 - DNA, 32 bp, Homo sapiens; identical to SEQ ID NO: 95429
  misc_feature 1..32: note = chr6:27755529-27755561
  misc_feature 1..32: note = Hypo
  source 1..32: mol_type = genomic DNA

SEQ ID NO: 125869 - DNA, 51 bp, Homo sapiens; identical to SEQ ID NO: 95430
  misc_feature 1..51: note = chr6:27759373-27759424
  misc_feature 1..51: note = Hyper
  source 1..51: mol_type = genomic DNA

SEQ ID NO: 125870 - DNA, 620 bp, Homo sapiens; identical to SEQ ID NO: 95431
  misc_feature 1..620: note = chr6:27774739-27775359
  misc_feature 1..620: note = Hyper
  source 1..620: mol_type = genomic DNA

SEQ ID NO: 125871 - DNA, 307 bp, Homo sapiens; identical to SEQ ID NO: 95432
  misc_feature 1..307: note = chr6:27775704-27776011
  misc_feature 1..307: note = Hyper
  source 1..307: mol_type = genomic DNA

SEQ ID NO: 125872 - DNA, 441 bp, Homo sapiens; identical to SEQ ID NO: 30426
  misc_feature 1..441: note = chr6:27777715-27778156
  misc_feature 1..441: note = Hyper
  source 1..441: mol_type = genomic DNA

SEQ ID NO: 125873 - DNA, 221 bp, Homo sapiens; identical to SEQ ID NO: 95434
  misc_feature 1..221: note = chr6:27782421-27782642
  misc_feature 1..221: note = Hyper
  source 1..221: mol_type = genomic DNA

SEQ ID NO: 125874 - DNA, 428 bp, Homo sapiens; identical to SEQ ID NO: 95435
  misc_feature 1..428: note = chr6:27832864-27833292
  misc_feature 1..428: note = Hyper
  source 1..428: mol_type = genomic DNA

SEQ ID NO: 125875 - DNA, 19 bp, Homo sapiens
  misc_feature 1..19: note = chr6:27833815-27833834
  misc_feature 1..19: note = Hyper
  source 1..19: mol_type = genomic DNA
aggctcagtggctcacgcc

SEQ ID NO: 125876 - DNA, 1398 bp, Homo sapiens
  misc_feature 1..1398: note = chr6:27834074-27835472
  misc_feature 1..1398: note = Hyper
  source 1..1398: mol_type = genomic DNA
aggaaaaaaaaataatccagtacagaatgacacggtcatatcaaattggcatgtaatagagaccccatcttgaaacttgctactatattgtcttgtgcgttgatagcatattatattaatgccgaacacattagtgacgccgaagtagctggtgcctaaatggcttaaacgcggaaaaaccacatacagatgatggaacaaaaactggccaatcagattatagagcgggctttttaaaatataagaagcttctttgtagctaggcgtctgacaaaaagcttgacaccaacttaacaaaaaccaacggctggaattcatactctaataacagactgcatgggtaaactacgtggggagtccaaccaacaccctggactcttgcttgccttgcgttactcgattagggttgagggagaactgcccgagatttttcgaatgcaaggaatcttgctgcctgatctaacatgttgtgcacagccattttttagaggtctctgggtggctctgaaaagagcctttggggctttgttgcggttttcacacgccagcttcctacttctttttggcagccgccttcttggcctttgcagctttaggttttgctgctttgggcttagcggctttgggctttgccgccttcggcttaactgccttgggcttggcaggactcttggttgcctttttcggtttggcagcggccttggccttcttagggctcttcgccacctttttgacgccagccgccgcgggcttcttcgccttcttcggagtcttcttcactgcctttttcgcccctgcagccttcttggccttcttaggcgtggcccccgcgggcttcttagctttagcggcgcctgccttcttggctttgggcttggcttccccggaggccgccttcttgttgagtttaaaggagccagaagcaccagtgcccttggtctgcaccagggtgcccttgctcaccaagctcttgaggcccagcttaatgcggctgttattcttctccacgtcgtagccaccggccgctaaggccttcttaagggctgccaaagaaaggccattgcgctccttagaagcagccacagccttggtgatcagctctgagactgggggccccgtcgctttgcgcttagcagcgccggcgccggcagccttcttagttgccttcttcttagccggggatttctccaccggcgctggggtggctgtctcggcaggagcggtttccgacatggtggcaagaaactgctagaagagaataagctcgaaatctaaagagcaggttttgcgttgctgctatgctcgggccccgggcttatataagccggcgctgccctgtgattggtggagcgtccaatccaccgccctctggccgccgccgctcgcggttggactccc

SEQ ID NO: 125877 - DNA, 890 bp, Homo sapiens; identical to SEQ ID NO: 30433
  misc_feature 1..890: note = chr6:27839683-27840573
  misc_feature 1..890: note = Hyper
  source 1..890: mol_type = genomic DNA

SEQ ID NO: 125878 - DNA, 153 bp, Homo sapiens; identical to SEQ ID NO: 95441
  misc_feature 1..153: note = chr6:27841104-27841257
  misc_feature 1..153: note = Hyper
  source 1..153: mol_type = genomic DNA

SEQ ID NO: 125879 - DNA, 461 bp, Homo sapiens; identical to SEQ ID NO: 95442
  misc_feature 1..461: note = chr6:27858279-27858740
  misc_feature 1..461: note = Hyper
  source 1..461: mol_type = genomic DNA

SEQ ID NO: 125880 - DNA, 127 bp, Homo sapiens; identical to SEQ ID NO: 95443
  misc_feature 1..127: note = chr6:27934883-27935010
  misc_feature 1..127: note = Hypo
  source 1..127: mol_type = genomic DNA

SEQ ID NO: 125881 - DNA, 254 bp, Homo sapiens; identical to SEQ ID NO: 95444
  misc_feature 1..254: note = chr6:28129376-28129630
  misc_feature 1..254: note = Hyper
  source 1..254: mol_type = genomic DNA

SEQ ID NO: 125882 - DNA, 40 bp, Homo sapiens; identical to SEQ ID NO: 95445
  misc_feature 1..40: note = chr6:28149166-28149206
  misc_feature 1..40: note = Hypo
  source 1..40: mol_type = genomic DNA

SEQ ID NO: 125883 - DNA, 1150 bp, Homo sapiens; identical to SEQ ID NO: 95446
  misc_feature 1..1150: note = chr6:28175189-28176339
  misc_feature 1..1150: note = Hyper
  source 1..1150: mol_type = genomic DNA

SEQ ID NO: 125884 - DNA, 170 bp, Homo sapiens; identical to SEQ ID NO: 30438
  misc_feature 1..170: note = chr6:28249409-28249579
  misc_feature 1..170: note = Hyper
  source 1..170: mol_type = genomic DNA

SEQ ID NO: 125885 - DNA, 38 bp, Homo sapiens; identical to SEQ ID NO: 30439
  misc_feature 1..38: note = chr6:28303451-28303489
  misc_feature 1..38: note = Hyper
  source 1..38: mol_type = genomic DNA

SEQ ID NO: 125886 - DNA, 370 bp, Homo sapiens; identical to SEQ ID NO: 95449
  misc_feature 1..370: note = chr6:28303931-28304301
  misc_feature 1..370: note = Hyper
  source 1..370: mol_type = genomic DNA

SEQ ID NO: 125887 - DNA, 824 bp, Homo sapiens
  misc_feature 1..824: note = chr6:28367054-28367878
  misc_feature 1..824: note = Hyper
  source 1..824: mol_type = genomic DNA
gcttccctctaacctcgtggtctgtgattataatctgaagtgaggaaggcccaggaaagggtccctaggacgccggcgagcgtctgtgacccaccactgtccagaaatgtcggtaagcgctgaacccaaggatacacagcccgaagcaaacgcggaaggtatgggccttacagcctggaattgctgcagagactgggagccaaaccctcatcctaatgtcccaacgcactttggggagggagagcttcccgcggatccgcctgggtttgggaggaccggggtccactctgcaccggccagggcctgaggggcccagcagctggaatacagcaatctcccgcccacctgctcgcagcgtacagagcacaacatcgctcacctgcggcccccagggccagaagagaactccctcctacggagcgaaggcaagaggcctcgaacccttttgggacccggaacccatcaaaagtgacccacaaaggccggaagcggccacggggggtctaagaaccagcccgcgcggggcgcacttccgcggccgctctaggaagggagcgaaaggggctttcaactcggtagtgtttccgcgcgtctacgtgagaggaaggttgatggctttcaggcccgctggtaaatggaacgggtttatcttctcctcttctttacccagccattgtccacacttcccccgacccgatgggtggtcgaggcttgtagaactgatcttaagacagggaaatcccttgcgtctccattcactttgggattctgtgtctctgaggttagagatgcctcaaagggatgttctccgggggaccttccca

SEQ ID NO: 125888 - DNA, 30 bp, Homo sapiens; identical to SEQ ID NO: 40776
  misc_feature 1..30: note = chr6:28395568-28395598
  misc_feature 1..30: note = Hypo
  source 1..30: mol_type = genomic DNA

SEQ ID NO: 125889 - DNA, 604 bp, Homo sapiens
  misc_feature 1..604: note = chr6:28410889-28411493
  misc_feature 1..604: note = Hyper
  source 1..604: mol_type = genomic DNA
cctaagatgcagatacggagagttcagagtgccatcagtacagggcagagaggttgaagagctcaggaacagacatagggtgggggaaaggggtaggggcaacgacgctgacttttggttaacaaagcccttccaggctgcggagcaacctcctctgcccttcacctgcccggcccatctctggccaagaagaccctgccgccaaatccccacacccagtccaggtcgcagtgcacagactggcccttccgaagcccctcagcggtagcccgactccgaagctcaccgaggcatccgtgagaggagatgccacctagcgcagatcacatctgctctgaatccttgacaaccgcagcccaaagaatgataaactacaaaggccggaaatgcgtcaccgcggcccgctctccgcgaaacagcggttccggctgtgttccttctaggaaggccggaggtttccacacctctgtggtcgtcactctgaatcccgtctgtagtcttaagtgagatactaggtgacacattgtcttccacgcggcaatataataacggccaacatagtgttttaacacgtattaattcattaccccgcataacaaccctg

SEQ ID NO: 125890 - DNA, 126 bp, Homo sapiens; identical to SEQ ID NO: 95458
  misc_feature 1..126: note = chr6:28414613-28414739
  misc_feature 1..126: note = Hyper
  source 1..126: mol_type = genomic DNA

SEQ ID NO: 125891 - DNA, 267 bp, Homo sapiens
  misc_feature 1..267: note = chr6:28414942-28415209
  misc_feature 1..267: note = Hyper
  source 1..267: mol_type = genomic DNA
atccagcattgcagccgccgcggcggtctaagagctcaaaccctttcaggcgcgcgcaggaggaggagcggcgggggcggcggaacaagacgaccctcacttaacgtggccgctgtcgccgtgggcatgctgggggcgtcctacgctgccgttcccctttatcggctctattgccagactactggacttggaggatcagcagtttcaggtcatgcctcagaccagattgaaaacatggtgcctgttaaggatcgaatcattaaaatt

SEQ ID NO: 125892 - DNA, 53 bp, Homo sapiens; identical to SEQ ID NO: 95461
  misc_feature 1..53: note = chr6:28457292-28457345
  misc_feature 1..53: note = Hyper
  source 1..53: mol_type = genomic DNA

SEQ ID NO: 125893 - DNA, 639 bp, Homo sapiens; identical to SEQ ID NO: 95462
  misc_feature 1..639: note = chr6:28457553-28458192
  misc_feature 1..639: note = Hyper
  source 1..639: mol_type = genomic DNA

SEQ ID NO: 125894 - DNA, 186 bp, Homo sapiens; identical to SEQ ID NO: 95479
  misc_feature 1..186: note = chr6:32632511-32632697
  misc_feature 1..186: note = Hyper
  source 1..186: mol_type = genomic DNA

SEQ ID NO: 125895 - DNA, 30 bp, Homo sapiens; identical to SEQ ID NO: 95486
  misc_feature 1..30: note = chr6:33579234-33579264
  misc_feature 1..30: note = Hypo
  source 1..30: mol_type = genomic DNA

SEQ ID NO: 125896 - DNA, 30 bp, Homo sapiens; identical to SEQ ID NO: 95487
  misc_feature 1..30: note = chr6:33609197-33609227
  misc_feature 1..30: note = Hypo
  source 1..30: mol_type = genomic DNA

SEQ ID NO: 125897 - DNA, 30 bp, Homo sapiens; identical to SEQ ID NO: 95490
  misc_feature 1..30: note = chr6:33678306-33678336
  misc_feature 1..30: note = Hypo
  source 1..30: mol_type = genomic DNA

SEQ ID NO: 125898 - DNA, 30 bp, Homo sapiens; identical to SEQ ID NO: 95491
  misc_feature 1..30: note = chr6:33678538-33678568
  misc_feature 1..30: note = Hypo
  source 1..30: mol_type = genomic DNA

SEQ ID NO: 125899 - DNA, 30 bp, Homo sapiens; identical to SEQ ID NO: 95492
  misc_feature 1..30: note = chr6:33684793-33684823
  misc_feature 1..30: note = Hypo
  source 1..30: mol_type = genomic DNA

SEQ ID NO: 125900 - DNA, 30 bp, Homo sapiens; identical to SEQ ID NO: 95493
  misc_feature 1..30: note = chr6:33748632-33748662
  misc_feature 1..30: note = Hypo
  source 1..30: mol_type = genomic DNA

SEQ ID NO: 125901 - DNA, 30 bp, Homo sapiens; identical to SEQ ID NO: 95494
  misc_feature 1..30: note = chr6:33761619-33761649
  misc_feature 1..30: note = Hypo
  source 1..30: mol_type = genomic DNA

SEQ ID NO: 125902 - DNA, 468 bp, Homo sapiens; identical to SEQ ID NO: 95495
  misc_feature 1..468: note = chr6:33955284-33955752
  misc_feature 1..468: note = Hypo
  source 1..468: mol_type = genomic DNA

SEQ ID NO: 125903 - DNA, 195 bp, Homo sapiens; identical to SEQ ID NO: 95496
  misc_feature 1..195: note = chr6:33995948-33996143
  misc_feature 1..195: note = Hypo
  source 1..195: mol_type = genomic DNA

SEQ ID NO: 125904 - DNA, 30 bp, Homo sapiens; identical to SEQ ID NO: 95497
  misc_feature 1..30: note = chr6:34021237-34021267
  misc_feature 1..30: note = Hypo
  source 1..30: mol_type = genomic DNA

SEQ ID NO: 125905 - DNA, 41 bp, Homo sapiens; identical to SEQ ID NO: 95498
  misc_feature 1..41: note = chr6:34034613-34034654
  misc_feature 1..41: note = Hypo
  source 1..41: mol_type = genomic DNA

SEQ ID NO: 125906 - DNA, 44 bp, Homo sapiens; identical to SEQ ID NO: 95499
  misc_feature 1..44: note = chr6:34037899-34037943
  misc_feature 1..44: note = Hypo
  source 1..44: mol_type = genomic DNA

SEQ ID NO: 125907 - DNA, 30 bp, Homo sapiens; identical to SEQ ID NO: 95500
  misc_feature 1..30: note = chr6:34038143-34038173
  misc_feature 1..30: note = Hypo
  source 1..30: mol_type = genomic DNA

SEQ ID NO: 125908 - DNA, 30 bp, Homo sapiens; identical to SEQ ID NO: 95502
  misc_feature 1..30: note = chr6:34100465-34100495
  misc_feature 1..30: note = Hyper
  source 1..30: mol_type = genomic DNA

SEQ ID NO: 125909 - DNA, 136 bp, Homo sapiens; identical to SEQ ID NO: 95503
  misc_feature 1..136: note = chr6:34110456-34110592
  misc_feature 1..136: note = Hyper
  source 1..136: mol_type = genomic DNA

SEQ ID NO: 125910 - DNA, 1919 bp, Homo sapiens; identical to SEQ ID NO: 95504
  misc_feature 1..1919: note = chr6:34111638-34113557
  misc_feature 1..1919: note = Hyper
  source 1..1919: mol_type = genomic DNA

SEQ ID NO: 125911 - DNA, 174 bp, Homo sapiens; identical to SEQ ID NO: 95505
  misc_feature 1..174: note = chr6:34119143-34119317
  misc_feature 1..174: note = Hyper
  source 1..174: mol_type = genomic DNA

SEQ ID NO: 125912 - DNA, 120 bp, Homo sapiens; identical to SEQ ID NO: 5043
  misc_feature 1..120: note = chr6:34170868-34170988
  misc_feature 1..120: note = Hypo
  source 1..120: mol_type = genomic DNA

SEQ ID NO: 125913 - DNA, 31 bp, Homo sapiens; identical to SEQ ID NO: 5044
  misc_feature 1..31: note = chr6:34171048-34171079
  misc_feature 1..31: note = Hypo
  source 1..31: mol_type = genomic DNA

SEQ ID NO: 125914 - DNA, 46 bp, Homo sapiens; identical to SEQ ID NO: 95509
  misc_feature 1..46: note = chr6:34392006-34392052
  misc_feature 1..46: note = Hypo
  source 1..46: mol_type = genomic DNA

SEQ ID NO: 125915 - DNA, 31 bp, Homo sapiens; identical to SEQ ID NO: 95510
  misc_feature 1..31: note = chr6:34396511-34396542
  misc_feature 1..31: note = Hypo
  source 1..31: mol_type = genomic DNA

SEQ ID NO: 125916 - DNA, 611 bp, Homo sapiens; identical to SEQ ID NO: 95511
  misc_feature 1..611: note = chr6:34433479-34434090
  misc_feature 1..611: note = Hyper
  source 1..611: mol_type = genomic DNA

SEQ ID NO: 125917 - DNA, 30 bp, Homo sapiens; identical to SEQ ID NO: 95512
  misc_feature 1..30: note = chr6:34490562-34490592
  misc_feature 1..30: note = Hypo
  source 1..30: mol_type = genomic DNA

SEQ ID NO: 125918 - DNA, 30 bp, Homo sapiens; identical to SEQ ID NO: 95513
  misc_feature 1..30: note = chr6:34498821-34498851
  misc_feature 1..30: note = Hypo
  source 1..30: mol_type = genomic DNA

SEQ ID NO: 125919 - DNA, 30 bp, Homo sapiens; identical to SEQ ID NO: 14846
  misc_feature 1..30: note = chr6:34514348-34514378
  misc_feature 1..30: note = Hypo
  source 1..30: mol_type = genomic DNA

SEQ ID NO: 125920 - DNA, 30 bp, Homo sapiens; identical to SEQ ID NO: 95515
  misc_feature 1..30: note = chr6:34518840-34518870
  misc_feature 1..30: note = Hypo
  source 1..30: mol_type = genomic DNA

SEQ ID NO: 125921 - DNA, 29 bp, Homo sapiens
  misc_feature 1..29: note = chr6:34535577-34535606
  misc_feature 1..29: note = Hypo
  source 1..29: mol_type = genomic DNA
gccctgccatcatagcgctgacagcggct

SEQ ID NO: 125922 - DNA, 29 bp, Homo sapiens
  misc_feature 1..29: note = chr6:34535906-34535935
  misc_feature 1..29: note = Hypo
  source 1..29: mol_type = genomic DNA
ggcgtgagtcactgcgcccagccatatcc

SEQ ID NO: 125923 - DNA, 70 bp, Homo sapiens; identical to SEQ ID NO: 95518
  misc_feature 1..70: note = chr6:34618507-34618577
  misc_feature 1..70: note = Hypo
  source 1..70: mol_type = genomic DNA

SEQ ID NO: 125924 - DNA, 70 bp, Homo sapiens; identical to SEQ ID NO: 40786
  misc_feature 1..70: note = chr6:34671603-34671673
  misc_feature 1..70: note = Hypo
  source 1..70: mol_type = genomic DNA

SEQ ID NO: 125925 - DNA, 19 bp, Homo sapiens
  misc_feature 1..19: note = chr6:34723890-34723909
  misc_feature 1..19: note = Hypo
  source 1..19: mol_type = genomic DNA
gggcgcggtgggtcacgcc

SEQ ID NO: 125926 - DNA, 19 bp, Homo sapiens
  misc_feature 1..19: note = chr6:34724209-34724228
  misc_feature 1..19: note = Hypo
  source 1..19: mol_type = genomic DNA
aagacgagataacctttct

SEQ ID NO: 125927 - DNA, 45 bp, Homo sapiens; identical to SEQ ID NO: 95523
  misc_feature 1..45: note = chr6:34854786-34854831
  misc_feature 1..45: note = Hypo
  source 1..45: mol_type = genomic DNA

SEQ ID NO: 125928 - DNA, 50 bp, Homo sapiens; identical to SEQ ID NO: 95525
  misc_feature 1..50: note = chr6:35026986-35027036
  misc_feature 1..50: note = Hypo
  source 1..50: mol_type = genomic DNA

SEQ ID NO: 125929 - DNA, 56 bp, Homo sapiens; identical to SEQ ID NO: 95526
  misc_feature 1..56: note = chr6:35109367-35109423
  misc_feature 1..56: note = Hypo
  source 1..56: mol_type = genomic DNA

SEQ ID NO: 125930 - DNA, 297 bp, Homo sapiens; identical to SEQ ID NO: 40791
  misc_feature 1..297: note = chr6:35149810-35150107
  misc_feature 1..297: note = Hypo
  source 1..297: mol_type = genomic DNA

SEQ ID NO: 125931 - DNA, 191 bp, Homo sapiens; identical to SEQ ID NO: 95528
  misc_feature 1..191: note = chr6:35181252-35181443
  misc_feature 1..191: note = Hyper
  source 1..191: mol_type = genomic DNA

SEQ ID NO: 125932 - DNA, 122 bp, Homo sapiens; identical to SEQ ID NO: 95529
  misc_feature 1..122: note = chr6:35181861-35181983
  misc_feature 1..122: note = Hyper
  source 1..122: mol_type = genomic DNA

SEQ ID NO: 125933 - DNA, 64 bp, Homo sapiens; identical to SEQ ID NO: 95530
  misc_feature 1..64: note = chr6:35182200-35182264
  misc_feature 1..64: note = Hyper
  source 1..64: mol_type = genomic DNA

SEQ ID NO: 125934 - DNA, 266 bp, Homo sapiens; identical to SEQ ID NO: 95531
  misc_feature 1..266: note = chr6:35309463-35309729
  misc_feature 1..266: note = Hypo
  source 1..266: mol_type = genomic DNA

SEQ ID NO: 125935 - DNA, 234 bp, Homo sapiens; identical to SEQ ID NO: 95532
  misc_feature 1..234: note = chr6:35359757-35359991
  misc_feature 1..234: note = Hypo
  source 1..234: mol_type = genomic DNA

SEQ ID NO: 125936 - DNA, 47 bp, Homo sapiens; identical to SEQ ID NO: 95533
  misc_feature 1..47: note = chr6:35454542-35454589
  misc_feature 1..47: note = Hypo
  source 1..47: mol_type = genomic DNA

SEQ ID NO: 125937 - DNA, 65 bp, Homo sapiens; identical to SEQ ID NO: 95534
  misc_feature 1..65: note = chr6:35466126-35466191
  misc_feature 1..65: note = Hyper
  source 1..65: mol_type = genomic DNA

SEQ ID NO: 125938 - DNA, 106 bp, Homo sapiens
  misc_feature 1..106: note = chr6:35479546-35479652
  misc_feature 1..106: note = Hyper
  source 1..106: mol_type = genomic DNA
ggggaaggctcctcccgcggcctccccgtccgcccagctgagccgagatgcggggttcagacagggtcccatccgcgggtccgcgaggcagcgcctctacccgcta

SEQ ID NO: 125939 - DNA, 30 bp, Homo sapiens; identical to SEQ ID NO: 95536
  misc_feature 1..30: note = chr6:35744172-35744202
  misc_feature 1..30: note = Hyper
  source 1..30: mol_type = genomic DNA

SEQ ID NO: 125940 - DNA, 103 bp, Homo sapiens; identical to SEQ ID NO: 95537
  misc_feature 1..103: note = chr6:35773143-35773246
  misc_feature 1..103: note = Hyper
  source 1..103: mol_type = genomic DNA

SEQ ID NO: 125941 - DNA, 25 bp, Homo sapiens
  misc_feature 1..25: note = chr6:35895210-35895235
  misc_feature 1..25: note = Hypo
  source 1..25: mol_type = genomic DNA
ccacggtgcccggcccccaggtatt

SEQ ID NO: 125942 - DNA, 257 bp, Homo sapiens
  misc_feature 1..257: note = chr6:35992277-35992534
  misc_feature 1..257: note = Hyper
  source 1..257: mol_type = genomic DNA
cacctggctccttggcgggggcgggagtgcgggcgctgggatcccacacggctctcgcctggctggcggcgctgcggacgcggataccggcggcggttcccgagccgttgtggcctagcccgcgggcgttccgggcgggctgaggagatgagagtgggggaggggacgaggaagaggagcatgagcagctgggctagggagccaggaaagtggtacctgggtcgccctcctcatacctgagtcgtgggatccccttg

SEQ ID NO: 125943 - DNA, 57 bp, Homo sapiens; identical to SEQ ID NO: 30462
  misc_feature 1..57: note = chr6:36088966-36089023
  misc_feature 1..57: note = Hyper
  source 1..57: mol_type = genomic DNA

SEQ ID NO: 125944 - DNA, 104 bp, Homo sapiens; identical to SEQ ID NO: 95542
  misc_feature 1..104: note = chr6:36165588-36165692
  misc_feature 1..104: note = Hypo
  source 1..104: mol_type = genomic DNA

SEQ ID NO: 125945 - DNA, 171 bp, Homo sapiens; identical to SEQ ID NO: 95543
  misc_feature 1..171: note = chr6:36214623-36214794
  misc_feature 1..171: note = Hypo
  source 1..171: mol_type = genomic DNA

SEQ ID NO: 125946 - DNA, 200 bp, Homo sapiens; identical to SEQ ID NO: 95544
  misc_feature 1..200: note = chr6:36238319-36238519
  misc_feature 1..200: note = Hypo
  source 1..200: mol_type = genomic DNA

SEQ ID NO: 125947 - DNA, 29 bp, Homo sapiens
  misc_feature 1..29: note = chr6:36240231-36240260
  misc_feature 1..29: note = Hypo
  source 1..29: mol_type = genomic DNA
acaggccacagacccggggccatggcctg

SEQ ID NO: 125948 - DNA, 369 bp, Homo sapiens; identical to SEQ ID NO: 95546
  misc_feature 1..369: note = chr6:36252866-36253235
  misc_feature 1..369: note = Hyper
  source 1..369: mol_type = genomic DNA

SEQ ID NO: 125949 - DNA, 164 bp, Homo sapiens; identical to SEQ ID NO: 95547
  misc_feature 1..164: note = chr6:36287117-36287281
  misc_feature 1..164: note = Hypo
  source 1..164: mol_type = genomic DNA

SEQ ID NO: 125950 - DNA, 30 bp, Homo sapiens; identical to SEQ ID NO: 95548
  misc_feature 1..30: note = chr6:36313961-36313991
  misc_feature 1..30: note = Hypo
  source 1..30: mol_type = genomic DNA

SEQ ID NO: 125951 - DNA, 56 bp, Homo sapiens; identical to SEQ ID NO: 95549
  misc_feature 1..56: note = chr6:36344624-36344680
  misc_feature 1..56: note = Hypo
  source 1..56: mol_type = genomic DNA

SEQ ID NO: 125952 - DNA, 30 bp, Homo sapiens; identical to SEQ ID NO: 95550
  misc_feature 1..30: note = chr6:36355327-36355357
  misc_feature 1..30: note = Hyper
  source 1..30: mol_type = genomic DNA

SEQ ID NO: 125953 - DNA, 18 bp, Homo sapiens
  misc_feature 1..18: note = chr6:36392123-36392141
  misc_feature 1..18: note = Hypo
  source 1..18: mol_type = genomic DNA
aaatgaagattcaggcgg

SEQ ID NO: 125954 - DNA, 91 bp, Homo sapiens; identical to SEQ ID NO: 95552
  misc_feature 1..91: note = chr6:36535507-36535598
  misc_feature 1..91: note = Hypo
  source 1..91: mol_type = genomic DNA

SEQ ID NO: 125955 - DNA, 367 bp, Homo sapiens; identical to SEQ ID NO: 95553
  misc_feature 1..367: note = chr6:36806909-36807276
  misc_feature 1..367: note = Hyper
  source 1..367: mol_type = genomic DNA

SEQ ID NO: 125956 - DNA, 495 bp, Homo sapiens; identical to SEQ ID NO: 95554
  misc_feature 1..495: note = chr6:36808059-36808554
  misc_feature 1..495: note = Hyper
  source 1..495: mol_type = genomic DNA

SEQ ID NO: 125957 - DNA, 30 bp, Homo sapiens; identical to SEQ ID NO: 14852
  misc_feature 1..30: note = chr6:36831576-36831606
  misc_feature 1..30: note = Hypo
  source 1..30: mol_type = genomic DNA

SEQ ID NO: 125958 - DNA, 30 bp, Homo sapiens; identical to SEQ ID NO: 40799
  misc_feature 1..30: note = chr6:36881595-36881625
  misc_feature 1..30: note = Hypo
  source 1..30: mol_type = genomic DNA

SEQ ID NO: 125959 - DNA, 30 bp, Homo sapiens; identical to SEQ ID NO: 95557
  misc_feature 1..30: note = chr6:36932229-36932259
  misc_feature 1..30: note = Hypo
  source 1..30: mol_type = genomic DNA

SEQ ID NO: 125960 - DNA, 56 bp, Homo sapiens; identical to SEQ ID NO: 95558
  misc_feature 1..56: note = chr6:36949243-36949299
  misc_feature 1..56: note = Hypo
  source 1..56: mol_type = genomic DNA

SEQ ID NO: 125961 - DNA, 46 bp, Homo sapiens; identical to SEQ ID NO: 40801
  misc_feature 1..46: note = chr6:37004177-37004223
  misc_feature 1..46: note = Hypo
  source 1..46: mol_type = genomic DNA

SEQ ID NO: 125962 - DNA, 105 bp, Homo sapiens
  misc_feature 1..105: note = chr6:37012625-37012730
  misc_feature 1..105: note = Hypo
  source 1..105: mol_type = genomic DNA
cagatcaaaaatggcggcagttggtgtgttctcggtttctcggctgctgggtcggtcccgcccacagctggggcggcctatgtcgagtggcgcccatggagaaga

SEQ ID NO: 125963 - DNA, 510 bp, Homo sapiens; identical to SEQ ID NO: 95560
  misc_feature 1..510: note = chr6:37024139-37024649
  misc_feature 1..510: note = Hypo
  source 1..510: mol_type = genomic DNA

SEQ ID NO: 125964 - DNA, 68 bp, Homo sapiens; identical to SEQ ID NO: 95561
  misc_feature 1..68: note = chr6:37027628-37027696
  misc_feature 1..68: note = Hypo
  source 1..68: mol_type = genomic DNA

SEQ ID NO: 125965 - DNA, 79 bp, Homo sapiens; identical to SEQ ID NO: 95562
  misc_feature 1..79: note = chr6:37053276-37053355
  misc_feature 1..79: note = Hypo
  source 1..79: mol_type = genomic DNA

SEQ ID NO: 125966 - DNA, 30 bp, Homo sapiens; identical to SEQ ID NO: 95563
  misc_feature 1..30: note = chr6:37139199-37139229
  misc_feature 1..30: note = Hyper
  source 1..30: mol_type = genomic DNA

SEQ ID NO: 125967 - DNA, 45 bp, Homo sapiens; identical to SEQ ID NO: 95564
  misc_feature 1..45: note = chr6:37275438-37275483
  misc_feature 1..45: note = Hypo
  source 1..45: mol_type = genomic DNA

SEQ ID NO: 125968 - DNA, 30 bp, Homo sapiens; identical to SEQ ID NO: 40805
  misc_feature 1..30: note = chr6:37358523-37358553
  misc_feature 1..30: note = Hypo
  source 1..30: mol_type = genomic DNA

SEQ ID NO: 125969 - DNA, 180 bp, Homo sapiens; identical to SEQ ID NO: 40806
  misc_feature 1..180: note = chr6:37391410-37391590
  misc_feature 1..180: note = Hypo
  source 1..180: mol_type = genomic DNA

SEQ ID NO: 125970 - DNA, 42 bp, Homo sapiens; identical to SEQ ID NO: 95567
  misc_feature 1..42: note = chr6:37392290-37392332
  misc_feature 1..42: note = Hypo
  source 1..42: mol_type = genomic DNA

SEQ ID NO: 125971 - DNA, 137 bp, Homo sapiens; identical to SEQ ID NO: 95569
  misc_feature 1..137: note = chr6:37526552-37526689
  misc_feature 1..137: note = Hypo
  source 1..137: mol_type = genomic DNA

SEQ ID NO: 125972 - DNA, 30 bp, Homo sapiens; identical to SEQ ID NO: 40807
  misc_feature 1..30: note = chr6:37557743-37557773
  misc_feature 1..30: note = Hypo
  source 1..30: mol_type = genomic DNA

SEQ ID NO: 125973 - DNA, 1256 bp, Homo sapiens
  misc_feature 1..1256: note = chr6:37663985-37665241
  misc_feature 1..1256: note = Hyper
  source 1..1256: mol_type = genomic DNA
agggccaggggatgccggcatcctgatcagggtgtcaagccctgagtagaagaagcgaagccgcagcaacagcggggaaggcgagcccgccgcccggccttggtgctgacagccggctcgcccgcaagccgcgcggcaactccggctcatgcatcgcttggcttccactccggaggccgagccaggacgaggtttcggtgcaagtcgctgcaccagtcctagactgggtctgtccgggtctcccgagccgaccgggtgctctcaagggttcctaatcattcccacctctagcagggtgtgggaaagtgggtgcctcctcctgacatcccggcttcccaccagaccctacgaccggcccctgtgttccgaagcagctagctcggtctccacgcgccctggagagggcggggacgcgggcatccactccagagtccgagtcgaggtctccaccaaaccccggcagcgcgcactttgcgcctcttgcaaagtttccgcgcgaggttaagccaaggtggagcgggacgcgggctcttaccgtagactccttgtccccggcagtggaaggggatcagcgccagaagtagaaggcaggtcacctccatcttcacggccggtgcttcatccccgcgaggcggcgcagcccgagaggcggcggggggcgcattcgccggggccccgcgacgcccctatgtccccccctttccctgagaggtgagagagagagcggcgacgaagaccaggagactgaagaggcggaggtggcggcgacccgtgtttctcctccggcggggccgctgcccgcgtggggacgcagggggcgctggcccagccccgggtgcctcggcgcgcccggcacagcagccagcgccccgacccgaggagcccggccgccgagccgccccgggtacccagggccgtccgcgcgggatgctaggcgccggggacctctcggcggcggaggcggcgcttcgatccaacaggccacggacgactgacaaacttgtcgtttccccgcactggggccgcccctcagcggagcggagtcggggaggccggggctccgctcgagttaatcaatctgctgtttccagtcctgcggccgctgccgtgggctcagcggcccgactccagggggccgggctgaaagcactcgcggcggcgaagcagccccgggcccggccctcctgatccggggagcagcgcgggctgggttcggccgagggacgagcgccgcgggtccccgggtccgtgaagtt

SEQ ID NO: 125974 - DNA, 470 bp, Homo sapiens; identical to SEQ ID NO: 95574
  misc_feature 1..470: note = chr6:37673008-37673478
  misc_feature 1..470: note = Hyper
  source 1..470: mol_type = genomic DNA

SEQ ID NO: 125975 - DNA, 30 bp, Homo sapiens; identical to SEQ ID NO: 95575
  misc_feature 1..30: note = chr6:37751633-37751663
  misc_feature 1..30: note = Hyper
  source 1..30: mol_type = genomic DNA

SEQ ID NO: 125976 - DNA, 30 bp, Homo sapiens; identical to SEQ ID NO: 40808
  misc_feature 1..30: note = chr6:37776410-37776440
  misc_feature 1..30: note = Hypo
  source 1..30: mol_type = genomic DNA

SEQ ID NO: 125977 - DNA, 32 bp, Homo sapiens; identical to SEQ ID NO: 95577
  misc_feature 1..32: note = chr6:37776736-37776768
  misc_feature 1..32: note = Hypo
  source 1..32: mol_type = genomic DNA

SEQ ID NO: 125978 - DNA, 21 bp, Homo sapiens
  misc_feature 1..21: note = chr6:37791857-37791878
  misc_feature 1..21: note = Hypo
  source 1..21: mol_type = genomic DNA
tattaacgtcatatttttagg

SEQ ID NO: 125979 - DNA, 34 bp, Homo sapiens; identical to SEQ ID NO: 40810
  misc_feature 1..34: note = chr6:38018000-38018034
  misc_feature 1..34: note = Hypo
  source 1..34: mol_type = genomic DNA

SEQ ID NO: 125980 - DNA, 98 bp, Homo sapiens; identical to SEQ ID NO: 95580
  misc_feature 1..98: note = chr6:38101874-38101972
  misc_feature 1..98: note = Hypo
  source 1..98: mol_type = genomic DNA

SEQ ID NO: 125981 - DNA, 30 bp, Homo sapiens; identical to SEQ ID NO: 40811
  misc_feature 1..30: note = chr6:38137726-38137756
  misc_feature 1..30: note = Hypo
  source 1..30: mol_type = genomic DNA

SEQ ID NO: 125982 - DNA, 43 bp, Homo sapiens; identical to SEQ ID NO: 95582
  misc_feature 1..43: note = chr6:38183138-38183181
  misc_feature 1..43: note = Hypo
  source 1..43: mol_type = genomic DNA

SEQ ID NO: 125983 - DNA, 30 bp, Homo sapiens; identical to SEQ ID NO: 40813
  misc_feature 1..30: note = chr6:38684078-38684108
  misc_feature 1..30: note = Hypo
  source 1..30: mol_type = genomic DNA

SEQ ID NO: 125984 - DNA, 30 bp, Homo sapiens; identical to SEQ ID NO: 95586
  misc_feature 1..30: note = chr6:38848809-38848839
  misc_feature 1..30: note = Hypo
  source 1..30: mol_type = genomic DNA

SEQ ID NO: 125985 - DNA, 723 bp, Homo sapiens
  misc_feature 1..723: note = chr6:39016211-39016934
  misc_feature 1..723: note = Hyper
  source 1..723: mol_type = genomic DNA
gggaccctgaatgggcgggggttgctgtagctttcctcagctgggagacccgggaggaggtccggggtgccagggtgggaggagggcctggcttgtcgctgaaagccggccaggcgcactgtcggcgctcagagctggtggccgcctcctgcgcttcctgattcccagccgcgctcgctcggagagcagtgcccgctatctcctggcccgggaccggcagaggggtgcggcggggcgggcccaggggtctctggcggccggaagaaccgggaccctgccaggcccctcccgcgggcagggcggcccctcgccggctcctcccccaccgcccgccaccagcccgggatcagtctccgcacgcggttccgcaggtggcagcgatggcccagtcctgaactccccgccatggccggcgcccccggcccgctgcgccttgcgctgctgctgctcgggatggtgggcagggccggcccccgcccccaggtgagatccagggaccccgacgacaccgggggaggcgggtggctctgcgggctgcaggcgcagtgtcctggtggagggccccgggacttgaacgaaactccgagaccgctggcgggggcatccgaaagcctcggggggagtagggactggagacttggtgcccctgggctggaaggcccaggtgagggcttggactacagaggattccccccaaccccagcgaggcgccctcttcctcgc

SEQ ID NO: 125986 - DNA, 307 bp, Homo sapiens; identical to SEQ ID NO: 95593
  misc_feature 1..307: note = chr6:39197084-39197391
  misc_feature 1..307: note = Hyper
  source 1..307: mol_type = genomic DNA

SEQ ID NO: 125987 - DNA, 911 bp, Homo sapiens; identical to SEQ ID NO: 95596
  misc_feature 1..911: note = chr6:39281088-39281999
  misc_feature 1..911: note = Hyper
  source 1..911: mol_type = genomic DNA

SEQ ID NO: 125988 - DNA, 29 bp, Homo sapiens
  misc_feature 1..29: note = chr6:39329863-39329892
  misc_feature 1..29: note = Hyper
  source 1..29: mol_type = genomic DNA
gcgtgagagtatgacgttctcaggactcg

SEQ ID NO: 125989 - DNA, 766 bp, Homo sapiens; identical to SEQ ID NO: 95599
  misc_feature 1..766: note = chr6:39759800-39760566
  misc_feature 1..766: note = Hyper
  source 1..766: mol_type = genomic DNA

SEQ ID NO: 125990 - DNA, 443 bp, Homo sapiens; identical to SEQ ID NO: 95601
  misc_feature 1..443: note = chr6:39901919-39902362
  misc_feature 1..443: note = Hyper
  source 1..443: mol_type = genomic DNA

SEQ ID NO: 125991 - DNA, 43 bp, Homo sapiens; identical to SEQ ID NO: 40814
  misc_feature 1..43: note = chr6:40244038-40244081
  misc_feature 1..43: note = Hypo
  source 1..43: mol_type = genomic DNA

SEQ ID NO: 125992 - DNA, 195 bp, Homo sapiens; identical to SEQ ID NO: 95605
  misc_feature 1..195: note = chr6:40317758-40317953
  misc_feature 1..195: note = Hypo
  source 1..195: mol_type = genomic DNA

SEQ ID NO: 125993 - DNA, 35 bp, Homo sapiens; identical to SEQ ID NO: 95606
  misc_feature 1..35: note = chr6:40360217-40360252
  misc_feature 1..35: note = Hypo
  source 1..35: mol_type = genomic DNA

SEQ ID NO: 125994 - DNA, 340 bp, Homo sapiens; identical to SEQ ID NO: 95607
  misc_feature 1..340: note = chr6:40554520-40554860
  misc_feature 1..340: note = Hyper
  source 1..340: mol_type = genomic DNA

SEQ ID NO: 125995 - DNA, 40 bp, Homo sapiens; identical to SEQ ID NO: 95608
  misc_feature 1..40: note = chr6:40555175-40555215
  misc_feature 1..40: note = Hyper
  source 1..40: mol_type = genomic DNA

SEQ ID NO: 125996 - DNA, 579 bp, Homo sapiens; identical to SEQ ID NO: 95609
  misc_feature 1..579: note = chr6:40555275-40555854
  misc_feature 1..579: note = Hyper
  source 1..579: mol_type = genomic DNA

SEQ ID NO: 125997 - DNA, 30 bp, Homo sapiens; identical to SEQ ID NO: 95610
  misc_feature 1..30: note = chr6:41160377-41160407
  misc_feature 1..30: note = Hypo
  source 1..30: mol_type = genomic DNA

SEQ ID NO: 125998 - DNA, 228 bp, Homo sapiens; identical to SEQ ID NO: 95611
  misc_feature 1..228: note = chr6:41337024-41337252
  misc_feature 1..228: note = Hyper
  source 1..228: mol_type = genomic DNA

SEQ ID NO: 125999 - DNA, 806 bp, Homo sapiens
  misc_feature 1..806: note = chr6:41339221-41340027
  misc_feature 1..806: note = Hyper
  source 1..806: mol_type = genomic DNA
tgcttccccagagagcgatcgccccggacttgtgcctgtgttccggcctagggcagccggaacctcccgatatccccagaggagtctcaggacagcgcacagggaagtactggcttggagctgcgtgttccttgggcggccggcggagggcgaagagcaggaagagcccgggggacgacggtagcagagtgttggggaggccacagacgcggactgcgtggagaaagcacgcacccgggccgcagtagccgggcagggggacggcggaaagcagccctctctggaacattttattctgatccccgcaggactcccccgcgagccccggcttgagcagtcgtgtaacaagtgtgcgattgcgcgtgcgactggtgtgtgcgcgtgggcacttacacgttcccggggaggctgggggcaggagcttcactgttcacacaaagagcgcttagaggaggaacatttaagtttgggggcaaagaaagaaaaaagagttaaaggtttaggagatgggggaggaggatggggcttaaggacgcggtgttgccgcggctcagccatcggggcgggaagctcggggagggagagcgcctgggcccgcttctcgcctattctacgcagaacttttctctcctccttcttccctcgctctgcctctctcggggcggtctccggggactgtctctcacatccattctcctctcctccttgatttatgctgcagagtggaacgaccttccctgacctcattttcatgtcggcgcgagcacacccggagccggctacgcacattccggaggaggcgcgcg

SEQ ID NO: 126000 - DNA, 1585 bp, Homo sapiens
  misc_feature 1..1585: note = chr6:41340707-41342292
  misc_feature 1..1585: note = Hyper
  source 1..1585: mol_type = genomic DNA
ggcacattcccagtgcgggcgctcgcagcaccacctcgcctggccgcccccagtcctgacccctttctagcgctggatcggccgggtccggcctccgtgctcgcggggtcgtccgtcggcgctggctagttaagaaaaataaacaacgttccaaatgaaggcgattcctttcaacccaagctccgccgcctgccagagaaatgcaaacagcggggtacggccggagtccgccccagcccccgcgccggagctgcgggtggcagggtcgggccgcggtaacccgagccgccgcgccggctccccgcgcgctgccctccgcctgccccttcgcccctgaccccgcagtcggcgcgctgggcctgcgcccgccatccccagcgccccccaccgggccgggacctccgccagcggtcctcggcgcccttcctgccccctccccccagcggtctcggccccatcccgaaccgccaccctgggatccccagccctcctgcgccctcgaggccaccgggctcctgcgagcaacgcttccctgcggcgaccgcgcgctgggatcactcaacaccaagaaaaaaaaaatgcactgggaacgacagaaacctgccttagcgaactatcctctagtggatcgggcgtggggggctgcttccagataggacccctgctcaccctgcagggtgcggccgggacaactacgggcgccactgcggaaggcctgacctgatccggcacggtgtggccaccgtgggcccacagagggtgaaggggtagcttatgctgagtgggggtgtccacctggacagaccaggcgagcctcgctcctggtgcgggagctagttttccctggatcttccgcggcagagaagcctgcgtccgggaccagcagagtgagccgaccggcggatgcagttgaccccattcgcgtccaaacttcacttcgagaaaacgcagccctgcgcgcagtccacgcaggacgcgacagcgccaccctcgtttgtacggctgcgcgaatgactcgagagagtcgcggtggctgcacgtgcgtgcgcaaagcgggaaggagtcagaaacagtcccgggcgcagagcgaagaaatcctgggacctcggcaagagggcctcaccactggagatggggtagctacgccgtgtggctgggggaggggtggtagggggcgcctagccagttgcaggggcctcgggactttccatggcctcacccctcttctaggacacgtggccagcgtcctccaggccaccactggggatgagggtgctcgagcctcggtgcccagagtgttgggaggagcggcggcgcacccgcttcctccgaattcctgcatcgcaacgctgggccgcaccgaaggcggtaggatgtgccaggcgtaaagctccgattggcttcgagagagtcgggggcaggcgaagacgcggaccacgcgggcttcctgtcctctttattcccagctctttttcgcgggataagcgtgtctgacggcttaagtgcagtctccctgcgtccctgcctgagctttccagctcccaattacttcgcgggattgggagccgagcgctctccctggagc

SEQ ID NO: 126001 - DNA, 923 bp, Homo sapiens; identical to SEQ ID NO: 95616
  misc_feature 1..923: note = chr6:41342779-41343702
  misc_feature 1..923: note = Hyper
  source 1..923: mol_type = genomic DNA

SEQ ID NO: 126002 - DNA, 30 bp, Homo sapiens; identical to SEQ ID NO: 95618
  misc_feature 1..30: note = chr6:41395227-41395257
  misc_feature 1..30: note = Hyper
  source 1..30: mol_type = genomic DNA

SEQ ID NO: 126003 - DNA, 557 bp, Homo sapiens; identical to SEQ ID NO: 95619
  misc_feature 1..557: note = chr6:41438018-41438575
  misc_feature 1..557: note = Hyper
  source 1..557: mol_type = genomic DNA

SEQ ID NO: 126004 - DNA, 235 bp, Homo sapiens; identical to SEQ ID NO: 95620
  misc_feature 1..235: note = chr6:41472913-41473148
  misc_feature 1..235: note = Hyper
  source 1..235: mol_type = genomic DNA

SEQ ID NO: 126005 - DNA, 856 bp, Homo sapiens
  misc_feature 1..856: note = chr6:41605766-41606622
  misc_feature 1..856: note = Hyper
  source 1..856: mol_type = genomic DNA
actgagaaacttgatcgcgcccatctttggggcaaagagatttggaggccgcaattattcagacagttccacgaagtggttgaggtttctctctttctcctgattttccagaaacttttgcagagtttggacaggcaaaggaaaacgtgcagcccgcggatctccgggcctcagagagcagggagtcggggagactgaggccccgctccgagagcgcggaggaagcgcgcccagccggcttcctgtgggggctcgggcctcgggcgccccgcggacagacgtgtccggctcctggctgggccaagcccggcgcgggggaggggacccgcagaggggcgactgagaaggcgaggagggggcggggagagggtgggccagggaagaggggaggggagaggcgagtaggggaggagcgaggggggctggagggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtgagtggacgtgggaggcgcgcatctgcgggggaatcgccccttgcccgcctccggcgccgcccgctgagccctgttttccgcaggtccggggccgatgtaccaggtgagcggccagcgcccctctggctgcgacgcgccctatggagcccccagcgcagccccgggcccaggtaggaccgggagtggcgagcgaagctggacaggggcgggtgggcggctgaaggggcca

SEQ ID NO: 126006 - DNA, 153 bp, Homo sapiens; identical to SEQ ID NO: 95624
  misc_feature 1..153: note = chr6:41709830-41709983
  misc_feature 1..153: note = Hypo
  source 1..153: mol_type = genomic DNA

SEQ ID NO: 126007 - DNA, 35 bp, Homo sapiens; identical to SEQ ID NO: 40816
  misc_feature 1..35: note = chr6:41715572-41715607
  misc_feature 1..35: note = Hypo
  source 1..35: mol_type = genomic DNA

SEQ ID NO: 126008 - DNA, 192 bp, Homo sapiens; identical to SEQ ID NO: 95626
  misc_feature 1..192: note = chr6:41773568-41773760
  misc_feature 1..192: note = Hypo
  source 1..192: mol_type = genomic DNA

SEQ ID NO: 126009 - DNA, 37 bp, Homo sapiens; identical to SEQ ID NO: 95627
  misc_feature 1..37: note = chr6:41919768-41919805
  misc_feature 1..37: note = Hypo
  source 1..37: mol_type = genomic DNA

SEQ ID NO: 126010 - DNA, 20 bp, Homo sapiens
  misc_feature 1..20: note = chr6:42062066-42062086
  misc_feature 1..20: note = Hypo
  source 1..20: mol_type = genomic DNA
gcctgagcaacacagcgaca

SEQ ID NO: 126011 - DNA, 23 bp, Homo sapiens
  misc_feature 1..23: note = chr6:42066001-42066024
  misc_feature 1..23: note = Hypo
  source 1..23: mol_type = genomic DNA
agccaccgcgcccagccaaggaa

SEQ ID NO: 126012 - DNA, 20 bp, Homo sapiens
  misc_feature 1..20: note = chr6:42076874-42076894
  misc_feature 1..20: note = Hypo
  source 1..20: mol_type = genomic DNA
ttaaatagggcagtccggcc

SEQ ID NO: 126013 - DNA, 155 bp, Homo sapiens; identical to SEQ ID NO: 95631
  misc_feature 1..155: note = chr6:42090718-42090873
  misc_feature 1..155: note = Hypo
  source 1..155: mol_type = genomic DNA

SEQ ID NO: 126014 - DNA, 61 bp, Homo sapiens; identical to SEQ ID NO: 95632
  misc_feature 1..61: note = chr6:42110212-42110273
  misc_feature 1..61: note = Hyper
  source 1..61: mol_type = genomic DNA

SEQ ID NO: 126015 - DNA, 77 bp, Homo sapiens; identical to SEQ ID NO: 95633
  misc_feature 1..77: note = chr6:42110870-42110947
  misc_feature 1..77: note = Hypo
  source 1..77: mol_type = genomic DNA

SEQ ID NO: 126016 - DNA, 90 bp, Homo sapiens; identical to SEQ ID NO: 95634
  misc_feature 1..90: note = chr6:42184556-42184646
  misc_feature 1..90: note = Hypo
  source 1..90: mol_type = genomic DNA

SEQ ID NO: 126017 - DNA, 176 bp, Homo sapiens; identical to SEQ ID NO: 40822
  misc_feature 1..176: note = chr6:42190336-42190512
  misc_feature 1..176: note = Hypo
  source 1..176: mol_type = genomic DNA

SEQ ID NO: 126018 - DNA, 38 bp, Homo sapiens; identical to SEQ ID NO: 95636
  misc_feature 1..38: note = chr6:42419139-42419177
  misc_feature 1..38: note = Hyper
  source 1..38: mol_type = genomic DNA

SEQ ID NO: 126019 - DNA, 41 bp, Homo sapiens; identical to SEQ ID NO: 95637
  misc_feature 1..41: note = chr6:42441227-42441268
  misc_feature 1..41: note = Hypo
  source 1..41: mol_type = genomic DNA

SEQ ID NO: 126020 - DNA, 30 bp, Homo sapiens; identical to SEQ ID NO: 95638
  misc_feature 1..30: note = chr6:42626581-42626611
  misc_feature 1..30: note = Hypo
  source 1..30: mol_type = genomic DNA

SEQ ID NO: 126021 - DNA, 30 bp, Homo sapiens; identical to SEQ ID NO: 95639
  misc_feature 1..30: note = chr6:42762875-42762905
  misc_feature 1..30: note = Hypo
  source 1..30: mol_type = genomic DNA

SEQ ID NO: 126022 - DNA, 43 bp, Homo sapiens; identical to SEQ ID NO: 95641
  misc_feature 1..43: note = chr6:42773440-42773483
  misc_feature 1..43: note = Hypo
  source 1..43: mol_type = genomic DNA

SEQ ID NO: 126023 - DNA, 43 bp, Homo sapiens; identical to SEQ ID NO: 95642
  misc_feature 1..43: note = chr6:42773723-42773766
  misc_feature 1..43: note = Hypo
  source 1..43: mol_type = genomic DNA

SEQ ID NO: 126024 - DNA, 224 bp, Homo sapiens; identical to SEQ ID NO: 40824
  misc_feature 1..224: note = chr6:42813314-42813538
  misc_feature 1..224: note = Hypo
  source 1..224: mol_type = genomic DNA

SEQ ID NO: 126025 - DNA, 37 bp, Homo sapiens; identical to SEQ ID NO: 40825
  misc_feature 1..37: note = chr6:42846392-42846429
  misc_feature 1..37: note = Hypo
  source 1..37: mol_type = genomic DNA

SEQ ID NO: 126026 - DNA, 96 bp, Homo sapiens; identical to SEQ ID NO: 40826
  misc_feature 1..96: note = chr6:42846609-42846705
  misc_feature 1..96: note = Hypo
  source 1..96: mol_type = genomic DNA

SEQ ID NO: 126027 - DNA, 28 bp, Homo sapiens
  misc_feature 1..28: note = chr6:42868404-42868432
  misc_feature 1..28: note = Hypo
  source 1..28: mol_type = genomic DNA
gagccaccgtgcccggccagcttgattt

SEQ ID NO: 126028 - DNA, 367 bp, Homo sapiens
  misc_feature 1..367: note = chr6:42879393-42879760
  misc_feature 1..367: note = Hyper
  source 1..367: mol_type = genomic DNA
gggtcttcctccttccggttcttgggaagatcctgcaatctgaaagaggcaggagagctctttccccatctgtaatgtggtaaccgagcccgagccagctcctccctgggctggagggtgggagagtcgttagggacacctgccccgctccctccccctcccgggggggaacccaccgcgacggcgcgcacctgggcgcgggctgtgcctgggaacgcgcggggaccgcggcctccaggcagccctgggaaagcaagggccgggagcgcagccctggaggcagagtgttccctcaggaccgtcaggagagcgccatccacaggattattaaaatagccatccagacggaaatcgagtgaggctggca

SEQ ID NO: 126029 - DNA, 38 bp, Homo sapiens; identical to SEQ ID NO: 95649
  misc_feature 1..38: note = chr6:42928321-42928359
  misc_feature 1..38: note = Hyper
  source 1..38: mol_type = genomic DNA

SEQ ID NO: 126030 - DNA, 26 bp, Homo sapiens
  misc_feature 1..26: note = chr6:42951450-42951476
  misc_feature 1..26: note = Hypo
  source 1..26: mol_type = genomic DNA
gggattacaggcgtgagacaccgtgc

SEQ ID NO: 126031 - DNA, 37 bp, Homo sapiens; identical to SEQ ID NO: 95651
  misc_feature 1..37: note = chr6:43119834-43119871
  misc_feature 1..37: note = Hypo
  source 1..37: mol_type = genomic DNA

SEQ ID NO: 126032 - DNA, 30 bp, Homo sapiens; identical to SEQ ID NO: 95652
  misc_feature 1..30: note = chr6:43149410-43149440
  misc_feature 1..30: note = Hypo
  source 1..30: mol_type = genomic DNA

SEQ ID NO: 126033 - DNA, 38 bp, Homo sapiens; identical to SEQ ID NO: 95653
  misc_feature 1..38: note = chr6:43193505-43193543
  misc_feature 1..38: note = Hypo
  source 1..38: mol_type = genomic DNA

SEQ ID NO: 126034 - DNA, 370 bp, Homo sapiens
  misc_feature 1..370: note = chr6:43211197-43211567
  misc_feature 1..370: note = Hyper
  source 1..370: mol_type = genomic DNA
ctgatgctggcggcgcggtgcattgtgggcagctccccgctctgccgctgccgccgccgtcgcccaaggaggatcggggccgggccgggccgggatgatccgggtcggaaggccgccgccgccggagggagcgggtcacccaacgccgcactgagccgcccccgccccgccccggccccgggggatgcgccgccccgagctgctgcctccgccgccgccgcagccgcagccgcagcgggcacagagcaggtgaggcggggcggggcgggccggggtcggggcgggggctccttcgtgggctcagggggctccgcctggctcgcctcccagcgcagccttcttgggctcccctccgcgctgctgtcgccgc

SEQ ID NO: 126035 - DNA, 106 bp, Homo sapiens; identical to SEQ ID NO: 95656
  misc_feature 1..106: note = chr6:43215365-43215471
  misc_feature 1..106: note = Hyper
  source 1..106: mol_type = genomic DNA

SEQ ID NO: 126036 - DNA, 438 bp, Homo sapiens; identical to SEQ ID NO: 30494
  misc_feature 1..438: note = chr6:43237245-43237683
  misc_feature 1..438: note = Hyper
  source 1..438: mol_type = genomic DNA

SEQ ID NO: 126037 - DNA, 164 bp, Homo sapiens; identical to SEQ ID NO: 95658
  misc_feature 1..164: note = chr6:43242769-43242933
  misc_feature 1..164: note = Hyper
  source 1..164: mol_type = genomic DNA

SEQ ID NO: 126038 - DNA, 42 bp, Homo sapiens; identical to SEQ ID NO: 30496
  misc_feature 1..42: note = chr6:43243433-43243475
  misc_feature 1..42: note = Hyper
  source 1..42: mol_type = genomic DNA

SEQ ID NO: 126039 - DNA, 190 bp, Homo sapiens
  misc_feature 1..190: note = chr6:43244084-43244274
  misc_feature 1..190: note = Hyper
  source 1..190: mol_type = genomic DNA
tagtgtacatagcggcgtcggggggtggccccaggcccgggtagaaaagcatgcactgagccccctgcccctagactgcgagtactgtacaaatccaacacttgaaaccgacacgcacacgcgcggcgccgccacgggggtgggacacggacacgcacccacgcgcacacggccgcgcacgggcggggag

SEQ ID NO: 126040 - DNA, 217 bp, Homo sapiens; identical to SEQ ID NO: 95661
  misc_feature 1..217: note = chr6:43251405-43251622
  misc_feature 1..217: note = Hypo
  source 1..217: mol_type = genomic DNA

SEQ ID NO: 126041 - DNA, 92 bp, Homo sapiens; identical to SEQ ID NO: 95662
  misc_feature 1..92: note = chr6:43276520-43276612
  misc_feature 1..92: note = Hyper
  source 1..92: mol_type = genomic DNA

SEQ ID NO: 126042 - DNA, 67 bp, Homo sapiens; identical to SEQ ID NO: 95665
  misc_feature 1..67: note = chr6:43423602-43423669
  misc_feature 1..67: note = Hyper
  source 1..67: mol_type = genomic DNA

SEQ ID NO: 126043 - DNA, 206 bp, Homo sapiens; identical to SEQ ID NO: 95666
  misc_feature 1..206: note = chr6:43424414-43424620
  misc_feature 1..206: note = Hypo
  source 1..206: mol_type = genomic DNA

SEQ ID NO: 126044 - DNA, 103 bp, Homo sapiens; identical to SEQ ID NO: 95667
  misc_feature 1..103: note = chr6:43425406-43425509
  misc_feature 1..103: note = Hypo
  source 1..103: mol_type = genomic DNA

SEQ ID NO: 126045 - DNA, 71 bp, Homo sapiens; identical to SEQ ID NO: 95668
  misc_feature 1..71: note = chr6:43476085-43476156
  misc_feature 1..71: note = Hypo
  source 1..71: mol_type = genomic DNA

SEQ ID NO: 126046 - DNA, 209 bp, Homo sapiens; identical to SEQ ID NO: 95669
  misc_feature 1..209: note = chr6:43478536-43478745
  misc_feature 1..209: note = Hypo
  source 1..209: mol_type = genomic DNA

SEQ ID NO: 126047 - DNA, 30 bp, Homo sapiens; identical to SEQ ID NO: 14862
  misc_feature 1..30: note = chr6:43486338-43486368
  misc_feature 1..30: note = Hypo
  source 1..30: mol_type = genomic DNA

SEQ ID NO: 126048 - DNA, 539 bp, Homo sapiens
  misc_feature 1..539: note = chr6:43612825-43613364
  misc_feature 1..539: note = Hyper
  source 1..539: mol_type = genomic DNA
cgctgacctgatggacgccgacagcctcctgctgtctctggagctggcgtccggcagtgggcagggcctcagcccggaccgtcgggcctcgctgctcacgtctcttatgctggttaagcgcgactaccgctatgatcgggttctcttctggggccgcatccttggcctcgtcgccgattactacatcgcgcagggcctgagtgaggaccagctcgcaccgcgcaagacgctctataggtgaggaggcccccgggacgggctccccagagggtggctacctggaggcagggcggggtgggcgggtcgcagcaattgaaaggggcggggcccatggggccaagggaggtgtgggcgggatctgagatgagtggaatgggggagaccctggggggcgggcctggggacggtcaagaggtggttgagggaaagggcggggatggggatgtctcggaatctgaggctagggcggagcctgagagggcggggcaatggacgggcgatgtcccccggagggcggggccttgcgagagcttgttctc

SEQ ID NO: 126049 - DNA, 149 bp, Homo sapiens; identical to SEQ ID NO: 95673
  misc_feature 1..149: note = chr6:43639599-43639748
  misc_feature 1..149: note = Hypo
  source 1..149: mol_type = genomic DNA

SEQ ID NO: 126050 - DNA, 30 bp, Homo sapiens; identical to SEQ ID NO: 95674
  misc_feature 1..30: note = chr6:43706822-43706852
  misc_feature 1..30: note = Hypo
  source 1..30: mol_type = genomic DNA

SEQ ID NO: 126051 - DNA, 72 bp, Homo sapiens; identical to SEQ ID NO: 40831
  misc_feature 1..72: note = chr6:43748463-43748535
  misc_feature 1..72: note = Hypo
  source 1..72: mol_type = genomic DNA

SEQ ID NO: 126052 - DNA, 30 bp, Homo sapiens; identical to SEQ ID NO: 95676
  misc_feature 1..30: note = chr6:43749564-43749594
  misc_feature 1..30: note = Hypo
  source 1..30: mol_type = genomic DNA

SEQ ID NO: 126053 - DNA, 30 bp, Homo sapiens; identical to SEQ ID NO: 95677
  misc_feature 1..30: note = chr6:43750186-43750216
  misc_feature 1..30: note = Hypo
  source 1..30: mol_type = genomic DNA

SEQ ID NO: 126054 - DNA, 37 bp, Homo sapiens; identical to SEQ ID NO: 95678
  misc_feature 1..37: note = chr6:43893966-43894003
  misc_feature 1..37: note = Hypo
  source 1..37: mol_type = genomic DNA

SEQ ID NO: 126055 - DNA, 55 bp, Homo sapiens
  misc_feature 1..55: note = chr6:43970452-43970507
  misc_feature 1..55: note = Hyper
  source 1..55: mol_type = genomic DNA
gtgcagacgctggcccggatgtcgcggaggactcgcgggccggtagagcgcgcgg

SEQ ID NO: 126056 - DNA, 73 bp, Homo sapiens; identical to SEQ ID NO: 95680
  misc_feature 1..73: note = chr6:44044377-44044450
  misc_feature 1..73: note = Hyper
  source 1..73: mol_type = genomic DNA

SEQ ID NO: 126057 - DNA, 100 bp, Homo sapiens; identical to SEQ ID NO: 95681
  misc_feature 1..100: note = chr6:44241060-44241160
  misc_feature 1..100: note = Hypo
  source 1..100: mol_type = genomic DNA

SEQ ID NO: 126058 - DNA, 30 bp, Homo sapiens; identical to SEQ ID NO: 95682
  misc_feature 1..30: note = chr6:44250199-44250229
  misc_feature 1..30: note = Hypo
  source 1..30: mol_type = genomic DNA

SEQ ID NO: 126059 - DNA, 350 bp, Homo sapiens; identical to SEQ ID NO: 95683
  misc_feature 1..350: note = chr6:44264917-44265267
  misc_feature 1..350: note = Hyper
  source 1..350: mol_type = genomic DNA

SEQ ID NO: 126060 - DNA, 279 bp, Homo sapiens; identical to SEQ ID NO: 95684
  misc_feature 1..279: note = chr6:44265528-44265807
  misc_feature 1..279: note = Hyper
  source 1..279: mol_type = genomic DNA

SEQ ID NO: 126061 - DNA, 41 bp, Homo sapiens; identical to SEQ ID NO: 14865
  misc_feature 1..41: note = chr6:44437145-44437186
  misc_feature 1..41: note = Hypo
  source 1..41: mol_type = genomic DNA

SEQ ID NO: 126062 - DNA, 53 bp, Homo sapiens; identical to SEQ ID NO: 95686
  misc_feature 1..53: note = chr6:44443969-44444022
  misc_feature 1..53: note = Hypo
  source 1..53: mol_type = genomic DNA

SEQ ID NO: 126063 - DNA, 51 bp, Homo sapiens; identical to SEQ ID NO: 95687
  misc_feature 1..51: note = chr6:44695868-44695919
  misc_feature 1..51: note = Hypo
  source 1..51: mol_type = genomic DNA

SEQ ID NO: 126064 - DNA, 30 bp, Homo sapiens; identical to SEQ ID NO: 95689
  misc_feature 1..30: note = chr6:45346268-45346298
  misc_feature 1..30: note = Hyper
  source 1..30: mol_type = genomic DNA

SEQ ID NO: 126065 - DNA, 520 bp, Homo sapiens; identical to SEQ ID NO: 95690
  misc_feature 1..520: note = chr6:45387578-45388098
  misc_feature 1..520: note = Hyper
  source 1..520: mol_type = genomic DNA

SEQ ID NO: 126066 - DNA, 38 bp, Homo sapiens; identical to SEQ ID NO: 30505
  misc_feature 1..38: note = chr6:45388359-45388397
  misc_feature 1..38: note = Hyper
  source 1..38: mol_type = genomic DNA

SEQ ID NO: 126067 - DNA, 55 bp, Homo sapiens; identical to SEQ ID NO: 95692
  misc_feature 1..55: note = chr6:45388792-45388847
  misc_feature 1..55: note = Hyper
  source 1..55: mol_type = genomic DNA

SEQ ID NO: 126068 - DNA, 683 bp, Homo sapiens; identical to SEQ ID NO: 95693
  misc_feature 1..683: note = chr6:45390864-45391547
  misc_feature 1..683: note = Hyper
  source 1..683: mol_type = genomic DNA

SEQ ID NO: 126069 - DNA, 16 bp, Homo sapiens
  misc_feature 1..16: note = chr6:45492559-45492575
  misc_feature 1..16: note = Hypo
  source 1..16: mol_type = genomic DNA
atggtagaggctgggc

SEQ ID NO: 126070 - DNA, 119 bp, Homo sapiens; identical to SEQ ID NO: 40835
  misc_feature 1..119: note = chr6:45609047-45609166
  misc_feature 1..119: note = Hypo
  source 1..119: mol_type = genomic DNA

SEQ ID NO: 126071 - DNA, 85 bp, Homo sapiens
  misc_feature 1..85: note = chr6:45631336-45631421
  misc_feature 1..85: note = Hyper
  source 1..85: mol_type = genomic DNA
atcctggtggagctgcggaccatgaacggccacctggacagcatagcgcgggccctcaccaaactggcttcgtccctggggcccc

SEQ ID NO: 126072 - DNA, 265 bp, Homo sapiens; identical to SEQ ID NO: 95696
  misc_feature 1..265: note = chr6:45982726-45982991
  misc_feature 1..265: note = Hyper
  source 1..265: mol_type = genomic DNA

SEQ ID NO: 126073 - DNA, 468 bp, Homo sapiens; identical to SEQ ID NO: 95697
  misc_feature 1..468: note = chr6:45983215-45983683
  misc_feature 1..468: note = Hyper
  source 1..468: mol_type = genomic DNA

SEQ ID NO: 126074 - DNA, 203 bp, Homo sapiens; identical to SEQ ID NO: 95698
  misc_feature 1..203: note = chr6:46138598-46138801
  misc_feature 1..203: note = Hyper
  source 1..203: mol_type = genomic DNA

SEQ ID NO: 126075 - DNA, 207 bp, Homo sapiens; identical to SEQ ID NO: 95699
  misc_feature 1..207: note = chr6:46161493-46161700
  misc_feature 1..207: note = Hypo
  source 1..207: mol_type = genomic DNA

SEQ ID NO: 126076 - DNA, 922 bp, Homo sapiens; identical to SEQ ID NO: 95701
  misc_feature 1..922: note = chr6:46702603-46703525
  misc_feature 1..922: note = Hyper
  source 1..922: mol_type = genomic DNA

SEQ ID NO: 126077 - DNA, 16 bp, Homo sapiens
  misc_feature 1..16: note = chr6:46951843-46951859
  misc_feature 1..16: note = Hypo
  source 1..16: mol_type = genomic DNA
ggagtcttgctctgtc

SEQ ID NO: 126078 - DNA, 93 bp, Homo sapiens; identical to SEQ ID NO: 95703
  misc_feature 1..93: note = chr6:47202360-47202453
  misc_feature 1..93: note = Hypo
  source 1..93: mol_type = genomic DNA

SEQ ID NO: 126079 - DNA, 127 bp, Homo sapiens; identical to SEQ ID NO: 95704
  misc_feature 1..127: note = chr6:47539998-47540125
  misc_feature 1..127: note = Hypo
  source 1..127: mol_type = genomic DNA

SEQ ID NO: 126080 - DNA, 32 bp, Homo sapiens; identical to SEQ ID NO: 95706
  misc_feature 1..32: note = chr6:47924450-47924482
  misc_feature 1..32: note = Hypo
  source 1..32: mol_type = genomic DNA

SEQ ID NO: 126081 - DNA, 43 bp, Homo sapiens; identical to SEQ ID NO: 95712
  misc_feature 1..43: note = chr6:48951303-48951346
  misc_feature 1..43: note = Hypo
  source 1..43: mol_type = genomic DNA

SEQ ID NO: 126082 - DNA, 89 bp, Homo sapiens; identical to SEQ ID NO: 95713
  misc_feature 1..89: note = chr6:49002323-49002412
  misc_feature 1..89: note = Hypo
  source 1..89: mol_type = genomic DNA

SEQ ID NO: 126083 - DNA, 172 bp, Homo sapiens; identical to SEQ ID NO: 40837
  misc_feature 1..172: note = chr6:49464924-49465096
  misc_feature 1..172: note = Hypo
  source 1..172: mol_type = genomic DNA

SEQ ID NO: 126084 - DNA, 424 bp, Homo sapiens; identical to SEQ ID NO: 95719
  misc_feature 1..424: note = chr6:49518576-49519000
  misc_feature 1..424: note = Hyper
  source 1..424: mol_type = genomic DNA

SEQ ID NO: 126085 - DNA, 20 bp, Homo sapiens
  misc_feature 1..20: note = chr6:49576100-49576120
  misc_feature 1..20: note = Hypo
  source 1..20: mol_type = genomic DNA
ctcttttttttgagacggag

SEQ ID NO: 126086 - DNA, 164 bp, Homo sapiens; identical to SEQ ID NO: 40838
  misc_feature 1..164: note = chr6:49590413-49590577
  misc_feature 1..164: note = Hypo
  source 1..164: mol_type = genomic DNA

SEQ ID NO: 126087 - DNA, 43 bp, Homo sapiens; identical to SEQ ID NO: 40839
  misc_feature 1..43: note = chr6:49590817-49590860
  misc_feature 1..43: note = Hypo
  source 1..43: mol_type = genomic DNA

SEQ ID NO: 126088 - DNA, 26 bp, Homo sapiens
  misc_feature 1..26: note = chr6:50207704-50207730
  misc_feature 1..26: note = Hypo
  source 1..26: mol_type = genomic DNA
ggcgagcgaggcgtggagcagtgacg

SEQ ID NO: 126089 - DNA, 30 bp, Homo sapiens; identical to SEQ ID NO: 95725
  misc_feature 1..30: note = chr6:50352067-50352097
  misc_feature 1..30: note = Hypo
  source 1..30: mol_type = genomic DNA

SEQ ID NO: 126090 - DNA, 424 bp, Homo sapiens; identical to SEQ ID NO: 95726
  misc_feature 1..424: note = chr6:50674326-50674750
  misc_feature 1..424: note = Hyper
  source 1..424: mol_type = genomic DNA

SEQ ID NO: 126091 - DNA, 1753 bp, Homo sapiens
  misc_feature 1..1753: note = chr6:50681604-50683357
  misc_feature 1..1753: note = Hyper
  source 1..1753: mol_type = genomic DNA
aggagctatctgatccgggcaaaaccattacaatttagatatctacctatagaacattttttttttcctttaaaaattggaaaatacaagaagtttggatttttttttcccgattctttttttggagggggaaattgcatcgtaagctttcggagaaacccaacatgtcaactacctttccgggactagtccacgatgccgaggtattattacttttttttttttttttttttgagcgcgcgtgtgtgtggcggcggcggcggtggcggcggtggcggcggcggtggcagcctcccctgtctctaatctatattggaccgttacgtttaattataatctgtctttcgggggaagttaaggaaggaaaggggagaaagttcgttatgacatctgtcgccagggagggcaactctctgccacgttaagaaacatttgccataatgagcgggaaaacataatcttaataataaaaggggggagtgaagagaaagagatagagacggaaagaaagattctcagaaaagcaaagaaaagggactggtggggaagcagtagatgcacaagggggatggggaaaacgcaccccttttggaatgggcttattcaaggaaagggaagcagaaaagagggagtcggattccctccctcgaatgactaaggaagggagcaagttgaacgatttgcacagactggattttttaaaatatatggacaatgattttgagcagcccgggccgaacatctcggcatagacaggcgcagaatttcgatgctggggtctagttagagtggcaaggcgccccgggccagcgctcttttcgggtggactcgttcctctgctacccgcggccccggagtcagttgcaaacctggatcccaacgccaagctccctgcacaagttgggcaggggctgtgtgtgtgtctgtgtgtgtgtgtctgtgcgtgtgtgtgcgtgtgtggtgtcacccgcacctatatagggtgggggattttttttccgctctctcgactgtgaggacgaggccgcccacccccagttcgcctgtttgcaaaggctctctggtgaagacgctgagacccggcttcggctcggcccgagtcctacgcgctcgctttccttggagtgccagagaaagctcctggctccgggagagcggcgccttggttgcaaaatgacaaacctcaagtttttctgctctcccttttccccctcttccttccagatacgtcacgacggatcaaacagctaccgtttgatgcagcttggctgtctggagtcagtagccaattccactgtcgcctattcctcctcctctcctttaacttactccaccaccggcaccgagtttgcgtccccctacttctccactaaccaccagtacaccccgctccaccaccagtccttccattacgagtttcagcacagccacccggccgtcacccccgacgcctactctctgaactctctccaccactcgcaacagtactaccagcagatccaccacggggagcccaccgactttattaacctgcacaatgcgcgggcgctcaagtcgtcctgcctggacgagcagaggcgggagctgggctgcctcgatgcctaccgccgccatgacctgtccctcatgagccatggctctcagtatggaatgcacccagatcaaagactcctgccagggcccagcctggggctggccgccgcgggagcagacgacttgcaggtaaataagcatgcagcgaatttgtctgctc

SEQ ID NO: 126092 - DNA, 88 bp, Homo sapiens; identical to SEQ ID NO: 95731
  misc_feature 1..88: note = chr6:50684010-50684098
  misc_feature 1..88: note = Hyper
  source 1..88: mol_type = genomic DNA

SEQ ID NO: 126093 - DNA, 64 bp, Homo sapiens; identical to SEQ ID NO: 95732
  misc_feature 1..64: note = chr6:50684905-50684969
  misc_feature 1..64: note = Hyper
  source 1..64: mol_type = genomic DNA

SEQ ID NO: 126094 - DNA, 161 bp, Homo sapiens; identical to SEQ ID NO: 95733
  misc_feature 1..161: note = chr6:50689869-50690030
  misc_feature 1..161: note = Hyper
  source 1..161: mol_type = genomic DNA

SEQ ID NO: 126095 - DNA, 178 bp, Homo sapiens; identical to SEQ ID NO: 95734
  misc_feature 1..178: note = chr6:50690519-50690697
  misc_feature 1..178: note = Hyper
  source 1..178: mol_type = genomic DNA

SEQ ID NO: 126096 - DNA, 30 bp, Homo sapiens; identical to SEQ ID NO: 95735
  misc_feature 1..30: note = chr6:50691065-50691095
  misc_feature 1..30: note = Hyper
  source 1..30: mol_type = genomic DNA

SEQ ID NO: 126097 - DNA, 767 bp, Homo sapiens
  misc_feature 1..767: note = chr6:50691789-50692556
  misc_feature 1..767: note = Hyper
  source 1..767: mol_type = genomic DNA
attaatatctgctgccgtggggggagaggtaacatggggggaggggtaacatgggggaggagggttaggaagggtgagaggctagagaggaagcagcagagaataattctccccacccaactcacaggcgcacctcgcagaaatgcaaccgcagaacaaacagggacaggaaactcttgtaatcgcttacacatttttaatgtgtcagaaaaaaaagagcgatcactggagatgaagaaggggagaagaaaaatccctgccgtttgtatttctttcatttgaattgtaaacatctgtttggctgtaaggcgaacagatcatttattttgctctcaagatttggtctaattatgtcaacaccgacgctacgacgagtggggcggcgctgtggctttggagaggatgcgcgcaccggcccagcgcccggaagcccgctaggaagtattgatcgcacctggagagcgcgcgggacctctcgccacagctgggtgcgttctgagacgggggaggcgcggaggccgtgagtatggctcagaggcagatttagaggctccagggacccgcggctccttggagacagccgccgctgtttcctctgccccagtagcctgggatgagaagagaaaaagctcacccaggctccggcgcttgtctttcccatccagttgcagcacagacggtggcggggtgtgtgtgtgtgtgtgtcggcggggggacctgtcttgtcctaccccgcagttcacaccctgcaacggggtagttgtttt

SEQ ID NO: 126098 - DNA, 30 bp, Homo sapiens; identical to SEQ ID NO: 95738
  misc_feature 1..30: note = chr6:50786551-50786581
  misc_feature 1..30: note = Hyper
  source 1..30: mol_type = genomic DNA

SEQ ID NO: 126099 - DNA, 1237 bp, Homo sapiens
  misc_feature 1..1237: note = chr6:50787164-50788401
  misc_feature 1..1237: note = Hyper
  source 1..1237: mol_type = genomic DNA
aggacagagaattagcgggaaagaagtagatggctggagatatggatggatagagcaaaatagaagtcgtagcagtttattagtttctgttttcttgtgttttgcttccttgagggtcactgcgtccgaacagaaatcgcagccgcctcctgtgtgggcatctttcacggaaatttctgcccacgttcaatgcgtacgggtctctagcactgaggctagctcaactcttcggggcaggagaagttgcgcccagccaggaggacgccagccgcctccggggcccggaccgcgctcgccaaagcccttttccggctcgggcgagggctgacgcggccagacggctccgctactcgcgggcgaggcggactaggcggacgaggcggccgaggcgggcgaggtgggagaggcgggcgaggtgggagaggcggccgaggcgggcgaggcgcggggcgcgcggcgggccaggctggggaccgggaagcccgcggagcctcgcttttaagcggaatggtctgggacagccccaggtggttgccaggggaagggaggaagggaaggttctgctgagacgtcgaggttggaaataaaaacttcggaaaggcgaagcggatttagaaaaggagggaagtcgaggcgggcgaagcgggccatggagattgctaagaggaaaagttggagagaaaaggaaggaagagaagcagactcccgggtggcgggcgcgggccgctaggtcagacgaaaggtggagggatgcagaggctccccaaagagccgagaaagacacgcgacccctccggatcgggacagctcctgaaagcccggcgcagagccgcctcgaagatcctaagagtgggcgactcacaggcgcggccggcaagctcctgggggactcgggctcggacgagcgcccacaggcagcgcctggcgcccacacctcctgcccccccccgaatcctaatgttggggtgtgtgtatgtgtggaggtatgtaggagagaggaggaggagataagagaggagagggagaaaagcaggagagagcgcgagagagcagagaggagagagattggtcttgttgctgaatgatgcttggggttttccttttctctttgtggttgtgtatcgactgtaacgaagagccgcgcctacgcgcctggtggggattgtttcggttcggcctccttttctttccttaacaggcgggataatggtaaagtccaaggcgctagaactgtcct

SEQ ID NO: 126100 - DNA, 205 bp, Homo sapiens; identical to SEQ ID NO: 95741
  misc_feature 1..205: note = chr6:50789374-50789579
  misc_feature 1..205: note = Hyper
  source 1..205: mol_type = genomic DNA

SEQ ID NO: 126101 - DNA, 509 bp, Homo sapiens
  misc_feature 1..509: note = chr6:50791123-50791632
  misc_feature 1..509: note = Hyper
  source 1..509: mol_type = genomic DNA
ggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccaggtaaccacaaacaaacaaacaaacaaacaaaaaagaccacgaataaggaatgct

SEQ ID NO: 126102 - DNA, 429 bp, Homo sapiens; identical to SEQ ID NO: 95744
  misc_feature 1..429: note = chr6:50793335-50793764
  misc_feature 1..429: note = Hyper
  source 1..429: mol_type = genomic DNA

SEQ ID NO: 126103 - DNA, 192 bp, Homo sapiens; identical to SEQ ID NO: 95745
  misc_feature 1..192: note = chr6:50794608-50794800
  misc_feature 1..192: note = Hyper
  source 1..192: mol_type = genomic DNA

SEQ ID NO: 126104 - DNA, 228 bp, Homo sapiens; identical to SEQ ID NO: 95746
  misc_feature 1..228: note = chr6:50798960-50799188
  misc_feature 1..228: note = Hyper
  source 1..228: mol_type = genomic DNA

SEQ ID NO: 126105 - DNA, 564 bp, Homo sapiens; identical to SEQ ID NO: 30531
  misc_feature 1..564: note = chr6:50803804-50804368
  misc_feature 1..564: note = Hyper
  source 1..564: mol_type = genomic DNA

SEQ ID NO: 126106 - DNA, 108 bp, Homo sapiens; identical to SEQ ID NO: 95748
  misc_feature 1..108: note = chr6:50805738-50805846
  misc_feature 1..108: note = Hyper
  source 1..108: mol_type = genomic DNA

SEQ ID NO: 126107 - DNA, 128 bp, Homo sapiens; identical to SEQ ID NO: 95749
  misc_feature 1..128: note = chr6:50808631-50808759
  misc_feature 1..128: note = Hyper
  source 1..128: mol_type = genomic DNA

SEQ ID NO: 126108 - DNA, 1054 bp, Homo sapiens
  misc_feature 1..1054: note = chr6:50810551-50811605
  misc_feature 1..1054: note = Hyper
  source 1..1054: mol_type = genomic DNA
gagaaaggctgaagtcgggggaaggcaaggctttggggtggaaggggtgcattacctccccacccccgctttcctttcagtcccagctgctcgagaagggagggcgctgggaaaggaaacagagcggaatcgcccacattagcctcgctcttcggtgacccggcgcctctgggcttgtgtgagcgtctcctttctaatgccaatgacaacgacactgagggtgattttctgtgcctcgcccacccctttgcaggcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaactttttaattttaaatatatttttaggaaactctcgcagtccccgccctccatctcacctcacccgtctcccaaccacc

SEQ ID NO: 126109 - DNA, 385 bp, Homo sapiens; identical to SEQ ID NO: 95752
  misc_feature 1..385: note = chr6:50811816-50812201
  misc_feature 1..385: note = Hyper
  source 1..385: mol_type = genomic DNA

SEQ ID NO: 126110 - DNA, 640 bp, Homo sapiens; identical to SEQ ID NO: 95753
  misc_feature 1..640: note = chr6:50813299-50813939
  misc_feature 1..640: note = Hyper
  source 1..640: mol_type = genomic DNA

SEQ ID NO: 126111 - DNA, 30 bp, Homo sapiens; identical to SEQ ID NO: 30538
  misc_feature 1..30: note = chr6:50814569-50814599
  misc_feature 1..30: note = Hyper
  source 1..30: mol_type = genomic DNA

SEQ ID NO: 126112 - DNA, 397 bp, Homo sapiens; identical to SEQ ID NO: 95755
  misc_feature 1..397: note = chr6:50817023-50817420
  misc_feature 1..397: note = Hyper
  source 1..397: mol_type = genomic DNA

SEQ ID NO: 126113 - DNA, 72 bp, Homo sapiens; identical to SEQ ID NO: 95756
  misc_feature 1..72: note = chr6:50817685-50817757
  misc_feature 1..72: note = Hyper
  source 1..72: mol_type = genomic DNA

SEQ ID NO: 126114 - DNA, 843 bp, Homo sapiens
  misc_feature 1..843: note = chr6:50818165-50819008
  misc_feature 1..843: note = Hyper
  source 1..843: mol_type = genomic DNA
ctgggtaataacacacgctccgggcacagggaccgcgggccaacgaaccgcgcgtgcgccgcgccagcctgcgtcgagccgtcgcacacggctccgggagcccgcgtctaggcacgctctccaggttgccaagcagggtgtcaacaagtgcgcacgcgcggacgcccacgcaggcgcacgcgccgtggcgcccccgggcgtaaccccagctgctgtgacgggccagggctcgcagctcgcctgctagagtttgtggcgcgccctcgggatcagggcactggggtttgaaggggctgcagcgtgggaagccttcaattttttttttttgtaagctgcgtgtgctcagattgaggaagcagttttgtcacacatgttcaacacgttccacgctggtcacaagctagcaaggtcaggtagtttttcgcccacttgttcgaaaacctattagttcctgcccaccctgctcttcgcttttcctcctctctcctaagggctgcagccttctggagctgactcaggcgagaggcgtccagagcccaaataggggtcacacctgctgtcgagagagtcctctgcataaaaatgctctttaaaatttttaaaatcagcataatggccaatggacttaacaaagcgtgacttgcccaggctgcacggagggcaactctggcagtcatctgtaactcgaccagttaacgtcccgaacgtgcctgttcgcggagatattagcaaacgtttcaaggatgtggctgtcagatgtcattagccaacgcttgctcacccaaccatttgcctaactgggaggagggcatggccacggcgtataggcgtagaatttggggg

SEQ ID NO: 126115 - DNA, 153 bp, Homo sapiens; identical to SEQ ID NO: 95758
  misc_feature 1..153: note = chr6:50819287-50819440
  misc_feature 1..153: note = Hyper
  source 1..153: mol_type = genomic DNA

SEQ ID NO: 126116 - DNA, 48 bp, Homo sapiens; identical to SEQ ID NO: 95762
  misc_feature 1..48: note = chr6:52102871-52102919
  misc_feature 1..48: note = Hypo
  source 1..48: mol_type = genomic DNA

SEQ ID NO: 126117 - DNA, 88 bp, Homo sapiens; identical to SEQ ID NO: 40842
  misc_feature 1..88: note = chr6:52156845-52156933
  misc_feature 1..88: note = Hypo
  source 1..88: mol_type = genomic DNA

SEQ ID NO: 126118 - DNA, 106 bp, Homo sapiens; identical to SEQ ID NO: 95764
  misc_feature 1..106: note = chr6:52226691-52226797
  misc_feature 1..106: note = Hyper
  source 1..106: mol_type = genomic DNA

SEQ ID NO: 126119 - DNA, 125 bp, Homo sapiens; identical to SEQ ID NO: 95765
  misc_feature 1..125: note = chr6:52227751-52227876
  misc_feature 1..125: note = Hyper
  source 1..125: mol_type = genomic DNA

SEQ ID NO: 126120 - DNA, 114 bp, Homo sapiens; identical to SEQ ID NO: 95766
  misc_feature 1..114: note = chr6:52268175-52268289
  misc_feature 1..114: note = Hypo
  source 1..114: mol_type = genomic DNA

SEQ ID NO: 126121 - DNA, 30 bp, Homo sapiens; identical to SEQ ID NO: 95767
  misc_feature 1..30: note = chr6:52344375-52344405
  misc_feature 1..30: note = Hypo
  source 1..30: mol_type = genomic DNA

SEQ ID NO: 126122 - DNA, 180 bp, Homo sapiens; identical to SEQ ID NO: 95768
  misc_feature 1..180: note = chr6:52928858-52929038
  misc_feature 1..180: note = Hypo
  source 1..180: mol_type = genomic DNA

SEQ ID NO: 126123 - DNA, 32 bp, Homo sapiens; identical to SEQ ID NO: 95769
  misc_feature 1..32: note = chr6:52929278-52929310
  misc_feature 1..32: note = Hypo
  source 1..32: mol_type = genomic DNA

SEQ ID NO: 126124 - DNA, 102 bp, Homo sapiens; identical to SEQ ID NO: 95770
  misc_feature 1..102: note = chr6:53052001-53052103
  misc_feature 1..102: note = Hypo
  source 1..102: mol_type = genomic DNA

SEQ ID NO: 126125 - DNA, 30 bp, Homo sapiens; identical to SEQ ID NO: 95771
  misc_feature 1..30: note = chr6:53212219-53212249
  misc_feature 1..30: note = Hyper
  source 1..30: mol_type = genomic DNA

SEQ ID NO: 126126 - DNA, 1193 bp, Homo sapiens; identical to SEQ ID NO: 95772
  misc_feature 1..1193: note = chr6:53212645-53213838
  misc_feature 1..1193: note = Hyper
  source 1..1193: mol_type = genomic DNA

SEQ ID NO: 126127 - DNA, 30 bp, Homo sapiens; identical to SEQ ID NO: 95773
  misc_feature 1..30: note = chr6:53214185-53214215
  misc_feature 1..30: note = Hyper
  source 1..30: mol_type = genomic DNA

SEQ ID NO: 126128 - DNA, 30 bp, Homo sapiens; identical to SEQ ID NO: 95774
  misc_feature 1..30: note = chr6:53438260-53438290
  misc_feature 1..30: note = Hypo
  source 1..30: mol_type = genomic DNA

SEQ ID NO: 126129 - DNA, 72 bp, Homo sapiens; identical to SEQ ID NO: 95775
  misc_feature 1..72: note = chr6:53517059-53517131
  misc_feature 1..72: note = Hyper
  source 1..72: mol_type = genomic DNA

SEQ ID NO: 126130 - DNA, 514 bp, Homo sapiens; identical to SEQ ID NO: 95776
  misc_feature 1..514: note = chr6:55443691-55444205
  misc_feature 1..514: note = Hyper
  source 1..514: mol_type = genomic DNA

SEQ ID NO: 126131 - DNA, 19 bp, Homo sapiens
  misc_feature 1..19: note = chr6:55678574-55678593
  misc_feature 1..19: note = Hypo
  source 1..19: mol_type = genomic DNA
acaccgtctcaaaaaaaaa

SEQ ID NO: 126132 - DNA, 433 bp, Homo sapiens; identical to SEQ ID NO: 95778
  misc_feature 1..433: note = chr6:56112173-56112606
  misc_feature 1..433: note = Hyper
  source 1..433: mol_type = genomic DNA

SEQ ID NO: 126133 - DNA, 41 bp, Homo sapiens; identical to SEQ ID NO: 95779
  misc_feature 1..41: note = chr6:56407898-56407939
  misc_feature 1..41: note = Hyper
  source 1..41: mol_type = genomic DNA

SEQ ID NO: 126134 - DNA, 49 bp, Homo sapiens; identical to SEQ ID NO: 95780
  misc_feature 1..49: note = chr6:56707974-56708023
  misc_feature 1..49: note = Hyper
  source 1..49: mol_type = genomic DNA

SEQ ID NO: 126135 - DNA, 279 bp, Homo sapiens; identical to SEQ ID NO: 95781
  misc_feature 1..279: note = chr6:56708790-56709069
  misc_feature 1..279: note = Hyper
  source 1..279: mol_type = genomic DNA

SEQ ID NO: 126136 - DNA, 508 bp, Homo sapiens
  misc_feature 1..508: note = chr6:56716187-56716695
  misc_feature 1..508: note = Hyper
  source 1..508: mol_type = genomic DNA
ctcttacctgctatccgaagcactgccctctcggcagggtccagcactgagcccccttgaatctttcttttcgatctctcatgtttaggcaaattccagggtaaggtgtctcccggagctggggatgcggagccagatttctggctgaaatcatcctcatcggaaaaatccgcagaggaagacatagagcagcgataggacgcgttcccggaactctacagagaatgacacagaaaaagcattaacagcaaaatactcacatatgctcaatgatttaaacatctcccccaccaaccaccgccgccctccctgcccccaaactgggtctggcatatcctgcaccatcctcggagctgagggaatatgcagaaaccaaaaaaataaaacccggagctcaccatcttttcttggccaagtctccaatcgtaaaaacaatacacaggcagtttcaatacatgaagatttgcacggaagaagtgtgtggcctgtggtccggccaccagctcac

SEQ ID NO: 126137 - DNA, 1567 bp, Homo sapiens; identical to SEQ ID NO: 95784
  misc_feature 1..1567: note = chr6:56818703-56820270
  misc_feature 1..1567: note = Hyper
  source 1..1567: mol_type = genomic DNA

SEQ ID NO: 126138 - DNA, 144 bp, Homo sapiens; identical to SEQ ID NO: 95785
  misc_feature 1..144: note = chr6:56820756-56820900
  misc_feature 1..144: note = Hyper
  source 1..144: mol_type = genomic DNA

SEQ ID NO: 126139 - DNA, 81 bp, Homo sapiens; identical to SEQ ID NO: 95786
  misc_feature 1..81: note = chr6:57694608-57694689
  misc_feature 1..81: note = Hypo
  source 1..81: mol_type = genomic DNA

SEQ ID NO: 126140 - DNA, 30 bp, Homo sapiens; identical to SEQ ID NO: 40846
  misc_feature 1..30: note = chr6:57979515-57979545
  misc_feature 1..30: note = Hypo
  source 1..30: mol_type = genomic DNA

SEQ ID NO: 126141 - DNA, 91 bp, Homo sapiens; identical to SEQ ID NO: 95789
  misc_feature 1..91: note = chr6:57985540-57985631
  misc_feature 1..91: note = Hypo
  source 1..91: mol_type = genomic DNA

SEQ ID NO: 126142 - DNA, 98 bp, Homo sapiens; identical to SEQ ID NO: 95790
  misc_feature 1..98: note = chr6:58002802-58002900
  misc_feature 1..98: note = Hypo
  source 1..98: mol_type = genomic DNA

SEQ ID NO: 126143 - DNA, 219 bp, Homo sapiens
  misc_feature 1..219: note = chr6:58147419-58147638
  misc_feature 1..219: note = Hyper
  source 1..219: mol_type = genomic DNA
tggcgtgcagaaaaccgcatctcccgaaatcccagaacgtaaacgtcgcccaggtactcgctctcttgtcattctccgggatgtaaaagactcggggtctcttcacggatcactgaaaccgccttctccgaggcctccagggtgactaaaagaaagggtgcgtgttctgtgttctcccgccggtgtgttcctcttcatgtccagccgcttgtgtctgtg

SEQ ID NO: 126144 - DNA, 218 bp, Homo sapiens; identical to SEQ ID NO: 95792
  misc_feature 1..218: note = chr6:58147758-58147976
  misc_feature 1..218: note = Hyper
  source 1..218: mol_type = genomic DNA

SEQ ID NO: 126145 - DNA, 39 bp, Homo sapiens; identical to SEQ ID NO: 95793
  misc_feature 1..39: note = chr6:58148912-58148951
  misc_feature 1..39: note = Hyper
  source 1..39: mol_type = genomic DNA

SEQ ID NO: 126146 - DNA, 22 bp, Homo sapiens
  misc_feature 1..22: note = chr6:58149309-58149331
  misc_feature 1..22: note = Hyper
  source 1..22: mol_type = genomic DNA
cgatccccgtacgggccacagg

SEQ ID NO: 126147 - DNA, 57 bp, Homo sapiens
  misc_feature 1..57: note = chr6:58180231-58180288
  misc_feature 1..57: note = Hyper
  source 1..57: mol_type = genomic DNA
ccgcagccctggagccgggcagtgagcgcctgcgcggcgctgcgtcgctgtccagga

SEQ ID NO: 126148 - DNA, 35 bp, Homo sapiens; identical to SEQ ID NO: 40847
  misc_feature 1..35: note = chr6:58504069-58504104
  misc_feature 1..35: note = Hypo
  source 1..35: mol_type = genomic DNA

SEQ ID NO: 126149 - DNA, 148 bp, Homo sapiens; identical to SEQ ID NO: 95799
  misc_feature 1..148: note = chr6:58588027-58588175
  misc_feature 1..148: note = Hypo
  source 1..148: mol_type = genomic DNA

SEQ ID NO: 126150 - DNA, 30 bp, Homo sapiens; identical to SEQ ID NO: 95816
  misc_feature 1..30: note = chr6:62692207-62692237
  misc_feature 1..30: note = Hypo
  source 1..30: mol_type = genomic DNA

SEQ ID NO: 126151 - DNA, 27 bp, Homo sapiens
  misc_feature 1..27: note = chr6:62849167-62849194
  misc_feature 1..27: note = Hypo
  source 1..27: mol_type = genomic DNA
ttcatatgggccaggcgcagtggctca

SEQ ID NO: 126152 - DNA, 1355 bp, Homo sapiens
  misc_feature 1..1355: note = chr6:62995356-62996711
  misc_feature 1..1355: note = Hyper
  source 1..1355: mol_type = genomic DNA
taaaaataaaaataccgatctgtagctacgaagctcttagaacactacattgatcaccatttacttccaaactgctttcccttccctctgcgaagtgaaaatgtccctgtagaccgcgttacatacactttatggtttctctatcaatgatcctaacaggtcacatcgccactgccattagatctccgtagctttggtcttctccaaattaagacgtggagaaggagcactgctgtccgccccaagaacggggtctgtccgcccgagctctaaggcgagcatcttcagggggacagtttctgcgaaggcggggagaggagtccctccccaacttcactcccctaatcaagccgcgggtgagataggcagccggcggtttgtgcccatctgtgggggcaagtcctaccttctgccaaaaggcgcgacgcatgcacaaaagatggatccaggctatctttctctgccatcagctcaggcaaatatttctcctcttccatagcgcggacttcggattgtccccgggcgaagcgcgaggttccgctcgctcggacgcaggcagggtcttggggcagcgcctggctcccgcgctgctcctcctccgcgcggcgagggatctctgtgcgtcctcactggcccatgcacccagcacctgcgactcccgccgtcgggctgcgtggccccgcgcccacacctgcccgtcccttccgtcgtccctcgctcgcgcagagccccggctcacaccagcggccttaactggagaggcgggaacaggacgcggcccacctccgccaaccactcattggtggtggtgccaggagaggcggggcgctggcagaaggccgcgggctctcattgggcggtagcgcaagtcgggtggcctgactggcaggaggcagctgcagaggggaagggagctcggaagatgcaaacgctttcttcttgcgcccaagccttccctggctattaggcatgcccagttttgtggagttctctgtgtcttcagctaaggcgcagaggagagagagcgcgggaaaagcgcaggttaaagagagaggtctgagtacaagtggacaggggagatggagatgagaagtgagccacccgagagggtggaaaagcgccagggaaagtctcaggaaggtagatgggacttcacctgcgtccctaaggcacaggtgtctcctttccctcacacagctcaggcgcactccagttgtgcaggaatcagcagcgcactgggtctggaaatacaatgaagactgcatgtgatcggcagctggtatttccgatgacctacatctcagggacgcagtaggatgttcattgataaacaaataaagcggctcgaagaaata

SEQ ID NO: 126153 - DNA, 30 bp, Homo sapiens; identical to SEQ ID NO: 95822
  misc_feature 1..30: note = chr6:63080264-63080294
  misc_feature 1..30: note = Hypo
  source 1..30: mol_type = genomic DNA

SEQ ID NO: 126154 - DNA, 83 bp, Homo sapiens; identical to SEQ ID NO: 95824
  misc_feature 1..83: note = chr6:63983649-63983732
  misc_feature 1..83: note = Hypo
  source 1..83: mol_type = genomic DNA

SEQ ID NO: 126155 - DNA, 155 bp, Homo sapiens; identical to SEQ ID NO: 95825
  misc_feature 1..155: note = chr6:64150663-64150818
  misc_feature 1..155: note = Hypo
  source 1..155: mol_type = genomic DNA

SEQ ID NO: 126156 - DNA, 68 bp, Homo sapiens; identical to SEQ ID NO: 95826
  misc_feature 1..68: note = chr6:64734852-64734920
  misc_feature 1..68: note = Hypo
  source 1..68: mol_type = genomic DNA

SEQ ID NO: 126157 - DNA, 34 bp, Homo sapiens; identical to SEQ ID NO: 95827
  misc_feature 1..34: note = chr6:64921720-64921754
  misc_feature 1..34: note = Hypo
  source 1..34: mol_type = genomic DNA

SEQ ID NO: 126158 - DNA, 326 bp, Homo sapiens; identical to SEQ ID NO: 30560
  misc_feature 1..326: note = chr6:69344323-69344649
  misc_feature 1..326: note = Hyper
  source 1..326: mol_type = genomic DNA

SEQ ID NO: 126159 - DNA, 1099 bp, Homo sapiens; identical to SEQ ID NO: 95835
  misc_feature 1..1099: note = chr6:69344943-69346042
  misc_feature 1..1099: note = Hyper
  source 1..1099: mol_type = genomic DNA

SEQ ID NO: 126160 - DNA, 370 bp, Homo sapiens; identical to SEQ ID NO: 30563
  misc_feature 1..370: note = chr6:69942843-69943213
  misc_feature 1..370: note = Hyper
  source 1..370: mol_type = genomic DNA

SEQ ID NO: 126161 - DNA, 38 bp, Homo sapiens; identical to SEQ ID NO: 95837
  misc_feature 1..38: note = chr6:70310230-70310268
  misc_feature 1..38: note = Hypo
  source 1..38: mol_type = genomic DNA

SEQ ID NO: 126162 - DNA, 38 bp, Homo sapiens; identical to SEQ ID NO: 30564
  misc_feature 1..38: note = chr6:70576959-70576997
  misc_feature 1..38: note = Hyper
  source 1..38: mol_type = genomic DNA

SEQ ID NO: 126163 - DNA, 344 bp, Homo sapiens; identical to SEQ ID NO: 95841
  misc_feature 1..344: note = chr6:70577295-70577639
  misc_feature 1..344: note = Hyper
  source 1..344: mol_type = genomic DNA

SEQ ID NO: 126164 - DNA, 1158 bp, Homo sapiens
  misc_feature 1..1158: note = chr6:70991963-70993121
  misc_feature 1..1158: note = Hyper
  source 1..1158: mol_type = genomic DNA
ttttctaaactccaacgaccaaacaggttacaatggggtctttgtaagtgaaacctcaaacctcagctgggcttatgcgcccccgccgggtcctccctcgcgcaggaggcgggaggcgctggagcctttgggaaactgctgaaatgctgatggaagccagggccgccaagttccgtcccggagccgccagcaccgctagctggactcggggttagtgcagctacggcgggctggaggagcgggagagggagcgtgcctggattcccgccttttccagcaaggcctgctgttgacagtgaccaggaggtggggcgggggagggggtgaggtgcgggaagtaagaagcaataacaggctaagaattaaacctcggtctccagtcacctattaccttcagcgccagagcctgcagtagggaggacccagattggggaggagccccccttcctagaccaaggggtcatctacggctctggacttcgataggactcgcggcaggtgctcgaggctggaggaagcgcgggtctgagagccctggggatgctccgcgcctttctcacagctccctcgaccgctgcgccccgacctgtcctcgtgtgcgcttgaaaaatgcaaacactccctgcccccaacttacctcgtcggtggtctggctgggctggagaagaaaagatggggagaaagtgagaaaagcacccctcaaactcgatcgcaacttacttgagccgcgcacaagcagagccccaacagcagcagccccagggccccgcggtcccgcgcagtccaggccatgcccgccgcccgccgctaatcccttggcccggctctgcagcctggttcccctctaggcttccagacccgccactagcataggtggcacttcgtccctgcagaaaaagcacccccgggagtagcggttgccaaagcgtccaggcccgggaggcgcgcgttccccctgtttatgaatggccccggagagggtcctgggattggaggagagctagggggcaggggaggacggatagaatgacaacagtcgcccttaaccccttccctgccgccgcacaggcgaggactgagcacgcagctctgcctccatcccatccaccccagtgcagcttctggctgtcctcggagacttcccgggtggcctgtgcc

SEQ ID NO: 126165 - DNA, 29 bp, Homo sapiens
  misc_feature 1..29: note = chr6:71122509-71122538
  misc_feature 1..29: note = Hyper
  source 1..29: mol_type = genomic DNA
aatcaatgatccttcgtgggcttctgtta

SEQ ID NO: 126166 - DNA, 30 bp, Homo sapiens; identical to SEQ ID NO: 95847
  misc_feature 1..30: note = chr6:71277663-71277693
  misc_feature 1..30: note = Hypo
  source 1..30: mol_type = genomic DNA

SEQ ID NO: 126167 - DNA, 107 bp, Homo sapiens; identical to SEQ ID NO: 95849
  misc_feature 1..107: note = chr6:71589506-71589613
  misc_feature 1..107: note = Hypo
  source 1..107: mol_type = genomic DNA

SEQ ID NO: 126168 - DNA, 217 bp, Homo sapiens; identical to SEQ ID NO: 95850
  misc_feature 1..217: note = chr6:71665506-71665723
  misc_feature 1..217: note = Hyper
  source 1..217: mol_type = genomic DNA

SEQ ID NO: 126169 - DNA, 1041 bp, Homo sapiens
  misc_feature 1..1041: note = chr6:71665945-71666986
  misc_feature 1..1041: note = Hyper
  source 1..1041: mol_type = genomic DNA
tcccgtgagccgggccgcccctgcggagcgggagtcgggcgcccccgcggcccaccgcgtagggagagaagtaggggcgcggggtgagcgggggcactggcctgcgcgtgtccacgtcgagcatgatgatgacaattaggatccagggcaggaggataaagaagcgggtgaaaagcgcggacttcatggtgcacgctccctggcctctcggacaccccagagaggggcgagccgagggaccccagtgcgcagcttggacagcggcggcgccagcacttagggagtggtgatgggtgcgctgtccatggggccgagggcgctgcagagacctggagccgcggggctcactacctgggcgtggaggagcggcaggttcgcgcaagctagagcgacaaggggtgcaggcgggcgggcaggggctgcccccgactccaggtgagctggcgggaagcgggactcggtccagccgcgcgccgccggtcccggagttgtgccgagtgcgggaaaggcgctgatccccaccgcgctctttctgaagagtggaagccgagaagcggcacccggtgcgcctcgccgctccagtccggcggtgctgcgggcacaagggctccagccgcgggcccccaggacgctctctgggacgccttcgagggcgggcggcggcgctgggggctttccttcctcacattcccgccggggtggcgaggagcgggtggagacgctgggggttgtgtcccggctgtgttcgcgcgccgcagcggaagcctgctctcagtcccttgctcttgtcttctcagaacctctccggatccagcagcaagatcccaaagcaaggaaagaaagaaaaagcgagggggcgggggcgctgcagaatccagcgtcctcccaagtcctcctgtgggaagacagcagcgctgctactggtggagaggggctgcgagagggaggcgcggagggaccccttggctctccgccgggtctggcgctaacggccccgcgagcaagctcgggaggcggccgctgcaccgcgggtggaggagc

SEQ ID NO: 126170 - DNA, 30 bp, Homo sapiens; identical to SEQ ID NO: 95853
  misc_feature 1..30: note = chr6:71868836-71868866
  misc_feature 1..30: note = Hypo
  source 1..30: mol_type = genomic DNA

SEQ ID NO: 126171 - DNA, 22 bp, Homo sapiens
  misc_feature 1..22: note = chr6:71955640-71955662
  misc_feature 1..22: note = Hypo
  source 1..22: mol_type = genomic DNA
atttgtgtctgtgcccgctacg

SEQ ID NO: 126172 - DNA, 805 bp, Homo sapiens
  misc_feature 1..805: note = chr6:72129732-72130537
  misc_feature 1..805: note = Hyper
  source 1..805: mol_type = genomic DNA
aaccacttgagcccacggcgcctaaagccgactcacccgcagcccgaggtgcgggagccctcggacggactccggcccgccccgcagtccccaccggccgcgctgcggccccggctgacgacgagtcgagaaagtcacccgcgatgaccgcggacgcgaggggcgggccgcgtcgcgccgccccgcggaggcgccgcaaacttttcccggttcgcaagttgccgggatctgcggccgcggaccgacttccttcgccggccaccggagggagggggcgcccctaccccgggagggggctgggcgagccgggagacggtcaagttggggtcgggggagcgcgggcgctccgcactctggggcacgcggggacgagcccggccgcattgtctgcgcggcctcggaacaagcacggccggcggtggcaccggcgggcgcggggaggagttgccgtcccctttcgccgccgccgcccaccgcgttctttgtgtgtctctcgccgccctccagccgcttcgccgctcgcctgacagctgatgggctcaccgcgccgggtcccgcgtcctctcggccgcagccggcggagcccggcccggcaggaggaggaggggagaagaggagcgttgacagatgctgtcttggagcgggcaccgccgggggaaaagtctggactgcctcggcgagaagcggccggtaggcaaccggccccagcctcgcattcgcctcaaagaccccaattggctaggagcccttccctccgcagcggctcgcgcagctccgctcttgcgccccgcgcccggctcagcgg

SEQ ID NO: 126173 - DNA, 280 bp, Homo sapiens
  misc_feature 1..280: note = chr6:72596035-72596315
  misc_feature 1..280: note = Hyper
  source 1..280: mol_type = genomic DNA
gcgaggtgctgtgcacgttggcgactgtaggggtagcggccggggcacgcgtggctcggacccggggagtgggcgggtgggtgcccgtgggcggagcggcgccgggactgagtggctggcagctatgtctgcgagagcagcggcatcaccctggatggaagcctctgagactccgcctaactgacacccaaactctccctctccctcccgcagccccaaattggaggcagcagagcctgggagcagcctccacggcggcagcggccgccccagtcccagc

SEQ ID NO: 126174 - DNA, 543 bp, Homo sapiens; identical to SEQ ID NO: 95863
  misc_feature 1..543: note = chr6:72596541-72597084
  misc_feature 1..543: note = Hyper
  source 1..543: mol_type = genomic DNA

SEQ ID NO: 126175 - DNA, 30 bp, Homo sapiens; identical to SEQ ID NO: 95865
  misc_feature 1..30: note = chr6:72806875-72806905
  misc_feature 1..30: note = Hypo
  source 1..30: mol_type = genomic DNA

SEQ ID NO: 126176 - DNA, 30 bp, Homo sapiens; identical to SEQ ID NO: 95866
  misc_feature 1..30: note = chr6:73063627-73063657
  misc_feature 1..30: note = Hypo
  source 1..30: mol_type = genomic DNA

SEQ ID NO: 126177 - DNA, 342 bp, Homo sapiens; identical to SEQ ID NO: 30579
  misc_feature 1..342: note = chr6:73329784-73330126
  misc_feature 1..342: note = Hyper
  source 1..342: mol_type = genomic DNA

SEQ ID NO: 126178 - DNA, 2471 bp, Homo sapiens
  misc_feature 1..2471: note = chr6:73330620-73333091
  misc_feature 1..2471: note = Hyper
  source 1..2471: mol_type = genomic DNA
gaaggccagaggctgcggccagtggcaccgtggcctctctctccgccaagggcgcataggctttgggccacccgggtgccaggggtggtggaagacccagtcagttgttccttgcaacaggtctctaagcttgtatgttacaacataaggtgggtggggtcggaaccccgaaaagccggcgtcctggacaccccatcctccaggtgttctttcccagacactgggtcctcgccgccgctgctgaacttctcaatcatatgactttctcggacttaaatggaaatttcttgacggagggaactgggtttgttctcccaggcttcgcgctgcagtcaggcagagccccggggcagctcgctcaccgcggaggagccactttggagttttacgccctttccacaccccacccatggactggaaaggatgttcagttactcgcgagcttgtctgatactgggatggaaagtcacagtccgcaggctggagtgaggcgcgggaagatgcctggtccttgcctcgcggacttggcagccgcgtcctgcgggtctgtccactgaactgctgaggactcgcccgtgtgcggggacccgagtgccacttcccggagcgttaccttgcgctccagcctccaggctagataatacctggaaggcagggcagggctgttcccgctctcaccccttgcggaaggatggcaggatccggcgcagcgacgtagcagcgggagggcacagcgacctgcatctccagtttctcctcaggacacaaggctgacttcaccttccggacagctgcaaagcccctgccagaaccaaaccgaactcgcgcctcggagaggggcttctggggccgtttcgctgcagggcgtggggagtggagagagggaaggggaagcctggggctgggtgtgcgcgcgtgggagcgcgcctcggagcgccccgcactcccccactctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtgtgagtacccgcgccccctgctatgcccgctgcaggggaccactgtccctggccccctggggcgtgctccgcgctcgcgcccttgggcccccgcgcgcgtgcacacgtggtggcttttatttcttcgcacgtgttcgtggtcttccttctggagcctctcccctcccccagccccacttctctcatctctacagcttgaaccttttccccgaggacacccaatgaactgcccggtagcttcaggctcccggggcgagagccaggcagacgcgggacttaggctgcgcggataattgggagcaattaggtcccaagatacgtaaacttcaaccgaacggggcgcccgggagctagggaatgcaaagggaggacaggcgcccgtgtgaggcttgagagtatactggagaggttaggaggtgatggcggggtaggacggggagaagtgagggggcatcgagggctaggtcctcagtcctaggggcggagtaggggaagctgctacttggagagagctgctaggttttaagcgcgcccggaaacacgcctcgccaccacccagccaccaccaacggaaaatctgtcagtgcatgtagcccttcctgccacggagaaggtggccaaggtctagaggaggccagcaggccaggcgaagcaacgctcccgcgctgcagggggcggggaggcagcggggaacctggggcgcaggaacgcgggcggaggtgcgatagcagaagcgcaaatgggtcgcctctgacagagatcgggcagtgggttaa

SEQ ID NO: 126179 - DNA, 179 bp, Homo sapiens; identical to SEQ ID NO: 40850
  misc_feature 1..179: note = chr6:73764839-73765018
  misc_feature 1..179: note = Hypo
  source 1..179: mol_type = genomic DNA

SEQ ID NO: 126180 - DNA, 489 bp, Homo sapiens; identical to SEQ ID NO: 95875
  misc_feature 1..489: note = chr6:73972632-73973121
  misc_feature 1..489: note = Hyper
  source 1..489: mol_type = genomic DNA

SEQ ID NO: 126181 - DNA, 681 bp, Homo sapiens; identical to SEQ ID NO: 8540
  misc_feature 1..681: note = chr6:74019413-74020094
  misc_feature 1..681: note = Hyper
  source 1..681: mol_type = genomic DNA

SEQ ID NO: 126182 - DNA, 144 bp, Homo sapiens
  misc_feature 1..144: note = chr6:74161177-74161321
  misc_feature 1..144: note = Hyper
  source 1..144: mol_type = genomic DNA
ggaaggtagggactgcggattgcggaaggccgagcagcggggctcggcgggagggcgccaagcagctcaccttcacgtgctcatagtagctcccggtgttcagcagcccgacgcctctgaacgcggagtcgcacttcagtctga

SEQ ID NO: 126183 - DNA, 438 bp, Homo sapiens
  misc_feature 1..438: note = chr6:74161627-74162065
  misc_feature 1..438: note = Hyper
  source 1..438: mol_type = genomic DNA
gctgcgtgtcctgggcgcgctgaggggcctttttggcgcgggccccagttgcgcggacgggcggcctctcctgggtgtccggggcgctctttttctgccgggatcccgacttcctggcggggccgaactttcccgccttaggcagggcggcctcgggggcagccggagactcggtgggatccatcggggcgcccctggcattccgtgcggaagccttgggggcagtggctccggcctcggaagctctctgcatggcctttccgtgccaaggctgcatggctggcgctttctgttccccgaaagaagaatccgtttcaggaaaaggccgcaagaggaagagccagcagcagctgttggaaaccaagcactactggcgggcacacaagagtctgcgacccgaaggggaaccccaggctgggaagtcgctgggagccacgc

SEQ ID NO: 126184 - DNA, 100 bp, Homo sapiens; identical to SEQ ID NO: 95881
  misc_feature 1..100: note = chr6:74234126-74234226
  misc_feature 1..100: note = Hypo
  source 1..100: mol_type = genomic DNA

SEQ ID NO: 126185 - DNA, 38 bp, Homo sapiens; identical to SEQ ID NO: 30589
  misc_feature 1..38: note = chr6:74405585-74405623
  misc_feature 1..38: note = Hyper
  source 1..38: mol_type = genomic DNA

SEQ ID NO: 126186 - DNA, 102 bp, Homo sapiens; identical to SEQ ID NO: 95883
  misc_feature 1..102: note = chr6:74405913-74406015
  misc_feature 1..102: note = Hyper
  source 1..102: mol_type = genomic DNA

SEQ ID NO: 126187 - DNA, 38 bp, Homo sapiens; identical to SEQ ID NO: 95884
  misc_feature 1..38: note = chr6:74406224-74406262
  misc_feature 1..38: note = Hyper
  source 1..38: mol_type = genomic DNA

SEQ ID NO: 126188 - DNA, 93 bp, Homo sapiens; identical to SEQ ID NO: 95885
  misc_feature 1..93: note = chr6:74698077-74698170
  misc_feature 1..93: note = Hypo
  source 1..93: mol_type = genomic DNA

SEQ ID NO: 126189 - DNA, 30 bp, Homo sapiens; identical to SEQ ID NO: 95886
  misc_feature 1..30: note = chr6:75167870-75167900
  misc_feature 1..30: note = Hypo
  source 1..30: mol_type = genomic DNA

SEQ ID NO: 126190 - DNA, 52 bp, Homo sapiens; identical to SEQ ID NO: 30591
  misc_feature 1..52: note = chr6:75914106-75914158
  misc_feature 1..52: note = Hyper
  source 1..52: mol_type = genomic DNA

SEQ ID NO: 126191 - DNA, 138 bp, Homo sapiens; identical to SEQ ID NO: 30592
  misc_feature 1..138: note = chr6:75914461-75914599
  misc_feature 1..138: note = Hyper
  source 1..138: mol_type = genomic DNA

SEQ ID NO: 126192 - DNA, 1108 bp, Homo sapiens
  misc_feature 1..1108: note = chr6:75914881-75915989
  misc_feature 1..1108: note = Hyper
  source 1..1108: mol_type = genomic DNA
gagctgggaaaagtccgccaagaatgagtaccctagtgctgcctaacccaccatctcggatgctctgaaaggtaggggaggaaggagccagaacactccactaggaatctgttacgagatgccacacacacccgtgcagcctcgacgagctgcagagcactcagcgggccctccaaagaattccgcaccgtgcgtcaccaaaataccttcccagcgcccccgccgcacgcctgccctccccgacaaagccacagccgcgagataaccagggccctgctgccccagaacccggcgcgccctccattgaaatcgacagcatctacagatgaaactcctctagaaacggaaacactgaacgggatgctttgcgtgcacaaaaccttgctcagctcttaagaaaagcaacattcccctctccctcaaaaaccccaaagaatcaccaaatcccagtatacaaggcaacgctctagcccacctacactattacaagtccaaactgtcctcgcccaggattcttcaccgctccgggcaaggtgcaagctagacgccgtttcccgagttgtctctgggaatgatgggggtaggggaaaggggacagaaaccaggctgacctgaggcggcggcaacagggagaggtagcggcggcgacagcggcttcccggcgtcggagaagctggtgctcggtgtggcccccacacgccccggcgataggcgctgcactccaggagcacctggcggccgccgaggcgtgggcagctgcggggaagtccaggaggaggaggagaatcccaggaggagaggcgggcgcggcaggaagactggagatggcctgagcctgcagctgccggcgcgcggacgcgtctggggcggttcgccttagccaagtggaaagagactccgcgccgcgggctacttaatagagggctgttcccagctctcagtttactcggttacgaaacgcctgagaaggtggacggctgccacggggtgatgtatgctcctccggcggtgaaggaggtctacttttgggaacgtgtgcatacttcgagcattccttcggcgtgaggtggcgatcgccgtagtagcagtgccccgctggggggcgggg

SEQ ID NO: 126193 - DNA, 190 bp, Homo sapiens; identical to SEQ ID NO: 95894
  misc_feature 1..190: note = chr6:75916269-75916459
  misc_feature 1..190: note = Hyper
  source 1..190: mol_type = genomic DNA

SEQ ID NO: 126194 - DNA, 40 bp, Homo sapiens; identical to SEQ ID NO: 95895
  misc_feature 1..40: note = chr6:75918553-75918593
  misc_feature 1..40: note = Hyper
  source 1..40: mol_type = genomic DNA

SEQ ID NO: 126195 - DNA, 17 bp, Homo sapiens
  misc_feature 1..17: note = chr6:76006457-76006474
  misc_feature 1..17: note = Hypo
  source 1..17: mol_type = genomic DNA
cccgcctcagcctccct

SEQ ID NO: 126196 - DNA, 27 bp, Homo sapiens
  misc_feature 1..27: note = chr6:78061285-78061312
  misc_feature 1..27: note = Hypo
  source 1..27: mol_type = genomic DNA
agaaatactgctgggcgcagtggctca

SEQ ID NO: 126197 - DNA, 1038 bp, Homo sapiens
  misc_feature 1..1038: note = chr6:78172176-78173214
  misc_feature 1..1038: note = Hyper
  source 1..1038: mol_type = genomic DNA
gtcttggtggctttgcgctccctagcggccatgagtttcttcttttccagcagggcgtcggagactcgcactttgacttggttcacatacacaggagatccggattcgctgggcacgtcgggaacccgcgagttaatagaggtgaccgaggacgtggacccgggggagtcggttatcagctgggctcgggtcaagcgcttgccggtcctgttgggcgtctgtttcaaaatccgggagcgggcttctacgtagatgcggccatagagggcgatgaggagcagggtggggaagtagaaagcacccaccgtggagtagaccgtgtagaggatgtggtcggtgttcaccacgcattccgacacctcctcttcggccttagcctgacgccagaagaagggcggcagcgagatagagatggagaagacccacaccagcgcgatcatgaccgccgccctcttgggagtccttttagctgagtactccacggcgtccgtgatggcccagtagcggtccagggcgatgacacagaggtgcaggatggaggcagtgcaacaagtgatgtccgacgacagccagaagtcacagaccacctggcccagtgtccagcggccggtgacagtgtacatggtgctgatgggcatcaccaggatggacacaagcaggtcggtgaccgccagagaggcgatcaggtagttagccggggtgtgcagtttccgggtccggtacactgtggcaatcacaaaggcattggagagcgtggtggccaaggtgatgagcgccaatagcataaccagcagtactttccagggtagggagatggagtcctggtaaatgtagtccttggcgctgcagttttgggagggagcagaggataagttggcttgaggaacccaggtctcggagcccgcgggcggcggtggagcgcactgagcacccggttcctccatggctctcctcgccccagctccggagcgcagctcttgggcatggagcggacgaaggagagggcggaaggaccgtggcgatcgcaggtttgtcccc

SEQ ID NO: 126198 - DNA, 355 bp, Homo sapiens
  misc_feature 1..355: note = chr6:78173701-78174056
  misc_feature 1..355: note = Hyper
  source 1..355: mol_type = genomic DNA
ctaggagcagcgctgcgccgcgcctcgcgccggagctctgccctccctctcttttcactctctggccactcggacgagctgccccgcggagacggagccataaaaggggggacacgggggctggagttgcggctgctcgggccgcgccgccgccaccgccaccctggtcccacgggagccactcggagccatgccactgggtgcgcgggtctggaggacctggcgcggcacactgggaaggggcaggtgtctgggggagctggagggacgcggcgtgcaccagcccgggagaagcgtgcgagctacggagcagatgggctctttatatagagtccaggtccggtccgccagagca

SEQ ID NO: 126199 - DNA, 234 bp, Homo sapiens; identical to SEQ ID NO: 30600
  misc_feature 1..234: note = chr6:78175915-78176149
  misc_feature 1..234: note = Hyper
  source 1..234: mol_type = genomic DNA

SEQ ID NO: 126200 - DNA, 84 bp, Homo sapiens; identical to SEQ ID NO: 30601
  misc_feature 1..84: note = chr6:78176445-78176529
  misc_feature 1..84: note = Hyper
  source 1..84: mol_type = genomic DNA

SEQ ID NO: 126201 - DNA, 44 bp, Homo sapiens; identical to SEQ ID NO: 30602
  misc_feature 1..44: note = chr6:78176790-78176834
  misc_feature 1..44: note = Hyper
  source 1..44: mol_type = genomic DNA

SEQ ID NO: 126202 - DNA, 606 bp, Homo sapiens
  misc_feature 1..606: note = chr6:79620288-79620894
  misc_feature 1..606: note = Hyper
  source 1..606: mol_type = genomic DNA
ggaaatggactaggtcgtaacaagaaaaagtgatatcaagcccgggcagaagggcgcattctcggcgcggagggcggagcctttcctggagtggcggcggatgacccgggctcccgctcctcacctcggcgtggggcgcaggcggcggccgcaaggaccgcggatgcttgaatcgcgcttctcgccggctgggactgccccagacacgcacaccctcccgacctccgccctgtcgcagttccagggcgctccgcgctgtcatgattgctgggtgcgcgctccgtgctgggacagccgcgcaccaacagcggagggcgttagcaccccaagacgctgctgcaggggtctgaaccgctccttggcctactggcaccgggtcctggacgaaatctaccgcggtccaactgagctttatcttgtgcggtgacgcccatgcctaggtcttgacacttccctcctatgccctttattgccaagggtcgggatggccttcgtgtcctctgcagcctccgccttccttctgctgccagcagctgtagattttacctctttcccctaacttcctctcaggctcctactccattcctatcgcgactgcttgagacc

SEQ ID NO: 126203 - DNA, 30 bp, Homo sapiens; identical to SEQ ID NO: 40853
  misc_feature 1..30: note = chr6:79699310-79699340
  misc_feature 1..30: note = Hypo
  source 1..30: mol_type = genomic DNA

SEQ ID NO: 126204 - DNA, 52 bp, Homo sapiens; identical to SEQ ID NO: 95915
  misc_feature 1..52: note = chr6:80341274-80341326
  misc_feature 1..52: note = Hyper
  source 1..52: mol_type = genomic DNA

SEQ ID NO: 126205 - DNA, 1078 bp, Homo sapiens; identical to SEQ ID NO: 95916
  misc_feature 1..1078: note = chr6:80656522-80657600
  misc_feature 1..1078: note = Hyper
  source 1..1078: mol_type = genomic DNA

SEQ ID NO: 126206 - DNA, 265 bp, Homo sapiens; identical to SEQ ID NO: 95917
  misc_feature 1..265: note = chr6:82461332-82461597
  misc_feature 1..265: note = Hyper
  source 1..265: mol_type = genomic DNA

SEQ ID NO: 126207 - DNA, 30 bp, Homo sapiens; identical to SEQ ID NO: 95918
  misc_feature 1..30: note = chr6:82462799-82462829
  misc_feature 1..30: note = Hyper
  source 1..30: mol_type = genomic DNA

SEQ ID NO: 126208 - DNA, 31 bp, Homo sapiens; identical to SEQ ID NO: 95919
  misc_feature 1..31: note = chr6:82958615-82958646
  misc_feature 1..31: note = Hypo
  source 1..31: mol_type = genomic DNA

SEQ ID NO: 126209 - DNA, 43 bp, Homo sapiens; identical to SEQ ID NO: 95920
  misc_feature 1..43: note = chr6:83073208-83073251
  misc_feature 1..43: note = Hyper
  source 1..43: mol_type = genomic DNA

SEQ ID NO: 126210 - DNA, 71 bp, Homo sapiens; identical to SEQ ID NO: 95921
  misc_feature 1..71: note = chr6:83073519-83073590
  misc_feature 1..71: note = Hyper
  source 1..71: mol_type = genomic DNA

SEQ ID NO: 126211 - DNA, 32 bp, Homo sapiens; identical to SEQ ID NO: 95922
  misc_feature 1..32: note = chr6:83073803-83073835
  misc_feature 1..32: note = Hyper
  source 1..32: mol_type = genomic DNA

SEQ ID NO: 126212 - DNA, 312 bp, Homo sapiens; identical to SEQ ID NO: 95923
  misc_feature 1..312: note = chr6:83074517-83074829
  misc_feature 1..312: note = Hyper
  source 1..312: mol_type = genomic DNA

SEQ ID NO: 126213 - DNA, 88 bp, Homo sapiens; identical to SEQ ID NO: 95924
  misc_feature 1..88: note = chr6:83458754-83458842
  misc_feature 1..88: note = Hypo
  source 1..88: mol_type = genomic DNA

SEQ ID NO: 126214 - DNA, 1986 bp, Homo sapiens
  misc_feature 1..1986: note = chr6:84417429-84419415
  misc_feature 1..1986: note = Hyper
  source 1..1986: mol_type = genomic DNA
attatggaccaagagcgcaggccgcaccaccagcatcccaggcgcctctgccgtgcgcatgtccctcttatataaagagatgcttacagtccaggtgctttttcttggggcccattacttcatgagtagtggctttgcagaccgctcttgctacagcagagcctgtaacgctgtactgagcggcggcgatccgatccgtgagcgtttggcccgacatcttctgtggtcgcgtctaccgcctcctcttctgcaggaaacaaggggagacggtccggctttaatccgcagaccctaccctccaagcacccaggccttgcctcctccagccgcgcggcggctctctcctcctccatccccaccctggcaccacctctcggagccagcaacgcgccaagccccgctcctgcgatgcggtccagggagtcttggccgtgagtagggccgtcacggaaccccagcgtgggctccagtcgcagcatcgtgacaccgtccccattctcccccggcccccacatagggccagactcaccccctggggacccccctgtcaatcagcactttccccgcaacctgacccgcgggtgctggactagccacaacgtgcgttggggttattccctgggcgccgcacccaccggtgcccatctcccacctcagcagactttcctcctagcagcccgcaggcttcggggaatgcatcggatacccaagccctggctgcctccctcctcctcctcgcgctgctgcagcaaagggctcgtcctccctcagtcgcgaaggagattatcctagcgttgcgccatgttatgccctcgcctccccttccttcctcgccgccggctccaaagcctcgccgaggcccatcgcccgggccccttccccccggttccaaatccctgccgcaggggccgcccgggagctctgcggaggcgccggagtcttggggcgcctcacccttcctggctttggagaggagccgggctgacagcgaagcccagtcccccgcccgccctggagcgctccgcggagctgtcactcggccgctgcccttctccgcaccctgggattatcctctgcggatccccgcgagaccctggcgcggggagggggccgagtacggccgcgggtactcaccccgcccctgagcggcgccgcccgccgcaggatgagcggagcccgggccgccgagggaagccgcgccggtggatgtgtgcgaccgcgcgtagccccggtgcccccgggcgcaaagtctccagccctggccgggccccgctcctcagctccgcggtcccggcgcccaccgcccctggcccctggccccagaagccagtacccgcccgccgccgcctcttctgccagcgccgccgcgtctctctagcgctccgagctgcgtccccatccccgcccccacctcagctgtggctcctccgacgagtcaggtgacggcggcggacaaacccggacgagccctcggcggagcgcctcgcggccccctcccagctactcacacacaccgccccccggggccgggagcttaaaggcgagggggcgcctcgcgcaagcatccccggcaagccggcggggagaagaaggaggcggggaggccgacacccacccagccagcggctctccgctgggcgccgggccgcccctccgctgctggcgccgcacccggcacgcactgggctcgcgcaccacgcacacctgcccgccgactgcggggggagccctgggcgttgggggcgttggccaagacgggcgagtgggcttctcgggttctactctgtgaaggccaaggcaagggcgtcgtcgcgcgctgcctggcggagcccagccccttccccacactgtcgctgacacgcccgcctgtcaaaggctccgaggcccagatgagcagggcgattttaaatgtcagatcctgccggccatccgcgaccgtcacctgtgcgtcttcagctcctcaggctcctccgcttgtctcagtta

SEQ ID NO: 126215 - DNA, 79 bp, Homo sapiens; identical to SEQ ID NO: 40855
  misc_feature 1..79: note = chr6:84513478-84513557
  misc_feature 1..79: note = Hypo
  source 1..79: mol_type = genomic DNA

SEQ ID NO: 126216 - DNA, 1142 bp, Homo sapiens
  misc_feature 1..1142: note = chr6:84562711-84563853
  misc_feature 1..1142: note = Hyper
  source 1..1142: mol_type = genomic DNA
gtcctgagtctccagcgaatcaagcaattaaccagtcacttggcctttttgcagaaatccacaaaacgtgtagactcgcttaattccatctcctcctggcctcttcacacggaaattggctgctcgggcgaatgttgtttttctccgcagccatgtgtcgaagggcgattaacattcgctcgacaaaaccctgtcccgggccatttgggagttgcacgcgttcacacccggggctcagcccggtgcgccttcacgcgcagcctttttgtttatgcggctagcagggagaggggcggagaggcagcgaacctctcaatgtgcagcaggccgcgagggctatataaagctcgggtctcggacctactggaactggtcaagattgcccgcgagctggcagcggccttccgcccagctctgcggcgtcatggagaacgcgggaggcgcagagggtacagagagtggagctgcggcgtgcgcggccaccgacggccctacgcggcgcgcgggcgcggactccgggtaggcttccccgcgctgctctgcgcctcccagcttcccccgtctctccctcctgcgcctccccagctcctcccctccaactctccatcccccactgcccggtgccagcgctcggcttcggtggattctcccgggtctgggctcacgtctcctctgcgcgccttgtgctcccctatcccgcagatacgcaggcttctggagaccctgggtggacgccggaggcaagaaagaagaggagacgccgaaccacgccgcggaggcggtgagtgagccacgcgtctcaggccgcgcctcccacgggtgcagaagatcgaccagggctctcgggacgcagggcctgagagagacatgcgagacaccgggtcctgcctctcgcttaacatcccgcctgccggtggccataaaggtgccgacgcggcggatgtgtcctctggagcgatgggccacaggcacccagccgggagcgaggctgctgagagccctggggttacattcccagcgggcacgaggaacactgggtcgtgcacgtttccactttctagaaggaggtgggtgataactggattcacttcctttcctctccagatgcccgatggccctggaatgaccgcagcctcaggaaa

SEQ ID NO: 126217 - DNA, 66 bp, Homo sapiens; identical to SEQ ID NO: 95936
  misc_feature 1..66: note = chr6:84743425-84743491
  misc_feature 1..66: note = Hyper
  source 1..66: mol_type = genomic DNA

SEQ ID NO: 126218 - DNA, 30 bp, Homo sapiens; identical to SEQ ID NO: 95937
  misc_feature 1..30: note = chr6:84847017-84847047
  misc_feature 1..30: note = Hypo
  source 1..30: mol_type = genomic DNA

SEQ ID NO: 126219 - DNA, 39 bp, Homo sapiens; identical to SEQ ID NO: 30618
  misc_feature 1..39: note = chr6:85471957-85471996
  misc_feature 1..39: note = Hyper
  source 1..39: mol_type = genomic DNA

SEQ ID NO: 126220 - DNA, 2365 bp, Homo sapiens; identical to SEQ ID NO: 95939
  misc_feature 1..2365: note = chr6:85472324-85474689
  misc_feature 1..2365: note = Hyper
  source 1..2365: mol_type = genomic DNA

SEQ ID NO: 126221 - DNA, 39 bp, Homo sapiens; identical to SEQ ID NO: 95940
  misc_feature 1..39: note = chr6:85474894-85474933
  misc_feature 1..39: note = Hyper
  source 1..39: mol_type = genomic DNA

SEQ ID NO: 126222 - DNA, 60 bp, Homo sapiens; identical to SEQ ID NO: 95941
  misc_feature 1..60: note = chr6:85475862-85475922
  misc_feature 1..60: note = Hyper
  source 1..60: mol_type = genomic DNA

SEQ ID NO: 126223 - DNA, 211 bp, Homo sapiens; identical to SEQ ID NO: 95942
  misc_feature 1..211: note = chr6:85476191-85476402
  misc_feature 1..211: note = Hyper
  source 1..211: mol_type = genomic DNA

SEQ ID NO: 126224 - DNA, 267 bp, Homo sapiens; identical to SEQ ID NO: 95943
  misc_feature 1..267: note = chr6:85476998-85477265
  misc_feature 1..267: note = Hyper
  source 1..267: mol_type = genomic DNA

SEQ ID NO: 126225 - DNA, 38 bp, Homo sapiens; identical to SEQ ID NO: 95944
  misc_feature 1..38: note = chr6:85478418-85478456
  misc_feature 1..38: note = Hyper
  source 1..38: mol_type = genomic DNA

SEQ ID NO: 126226 - DNA, 200 bp, Homo sapiens; identical to SEQ ID NO: 95945
  misc_feature 1..200: note = chr6:85478694-85478894
  misc_feature 1..200: note = Hyper
  source 1..200: mol_type = genomic DNA

SEQ ID NO: 126227 - DNA, 30 bp, Homo sapiens; identical to SEQ ID NO: 95946
  misc_feature 1..30: note = chr6:85481458-85481488
  misc_feature 1..30: note = Hyper
  source 1..30: mol_type = genomic DNA

SEQ ID NO: 126228 - DNA, 396 bp, Homo sapiens; identical to SEQ ID NO: 95947
  misc_feature 1..396: note = chr6:85482401-85482797
  misc_feature 1..396: note = Hyper
  source 1..396: mol_type = genomic DNA

SEQ ID NO: 126229 - DNA, 2076 bp, Homo sapiens
  misc_feature 1..2076: note = chr6:85482857-85484933
  misc_feature 1..2076: note = Hyper
  source 1..2076: mol_type = genomic DNA
gtgtaaaatcaaaaaagacttgggaggcaaacttgggtgggaagcactgaggaaggcgaaacaattcccaacttatctggatcccagacgagtccctctgattgcttaagtcactagaaaaggagattcgtctcagcgattaacaatgataccctttttaagagagatcaaagaaggcgcctagggaagctctacaacgcggcttcttggagttctgaggccgcctgcgcattcactttccagtgtaagcccccgctccggaatcccggctccagcccagcccgcgcccccttccctggaaagacctggccggccgcgcccccgaacccccgaggcgtgggtgtcaggctaagcggggctggtccgaccggtcgcttccagctctctccacctgttggaaagcccaggcccaagaaccgcgccagcggcggcagcacgtcactcggcggccacggggagtcagggagcgcggaacgcgggtttctgttgataagtgcaaagtacggccctctcggtgctaagtgcacagtaagtgcgaagaataaatacatcatctcccggggcggctgtctcgaaaacgcctctcagctgcctgcgtttcagagcccgtcaagggttatagcttagtgtgggcgtccgcgccgcgcctgcgcctccgagcgccggccgagaagggcgcgcagccacagccaccacatgccactagccccgcaaggcgcctgactcctctaaggggaactcgtaatgctcaccaaaagcctcagaaaccctggaacctataagaccgcaccaccgcgcaaacggtgtcccgggctgcgctcccgcactgcaccggcagcctatgaggcgaggccaacccggagactgcgcgcgacgggcgtgcgtgcgtgcgcccgcagattcgcttcaggcggtaggtgtggagtacctgggcagctccggcgggaatggtgttggggagaaggagctgtcattcatagtcttctacatatctgaataaagaattgctttttaaaaataggttcagagcctagtgagtgaaaacttaaaagtccccgcgaggagctctagttcccgggcggcgcggccccgactttctcgtcggtagcgctctggccttgggcgcccgccgctttggctatggaggtacagtggccgcgtcccggggagcctgggcctccttgcggctccgagcctccgcggcgcccgcgccccgactctccggtcccggctctctccaggcccggctgtctccggtccctcactgacttcgccagccgcaccacccacctctttctcccgcagacgtaaacccgaatacgccccggccttgggcctagggcctcggcctcgcctggctctacaggattcgggggcggggtaggccggcagagctcagctcgcgccgtgggtccacatgtttttatttcgtgaccctgaccgcgtcccggccataacttcctctgcgttacaacggggataataatccccggccggcctgccggatggtggcgggataatatatcccggtgagggaaggaccgagcttggcagagacacttaactgtcccactgtgtggctgttcacagtccgcccagatttaggggtgggatggggggttttcgggccccggcctgctccccctctccagaccccgcagaaaggggttcatgggcaattaggttccgctggactcgccgggctgcgggcgggtgagcgccgccgggcaccgggcgggggcacgtggcgccctctggggaccgtccgccgcactgcctggcgtcctgcctggggaggcgcagcctagcccagcacctcccgccgtctcaggctcggaggagctctgtacctggctccgcgctgacccctccacctggctgaaggcagcagccctgggagactctggcactctgggccggagcaggagctgtgccccatggcaacccagactgaaagggaagccctgtctgttgctctttgctgcggattcgagggaggccgtctcgagtcgctcagaagcgacctaaagaaggcactggcctctgtgcgccgaacctccacgagatagactaagt

SEQ ID NO: 126230 - DNA, 61 bp, Homo sapiens; identical to SEQ ID NO: 95953
  misc_feature 1..61: note = chr6:86159448-86159509
  misc_feature 1..61: note = Hyper
  source 1..61: mol_type = genomic DNA

SEQ ID NO: 126231 - DNA, 125 bp, Homo sapiens; identical to SEQ ID NO: 30627
  misc_feature 1..125: note = chr6:86159778-86159903
  misc_feature 1..125: note = Hyper
  source 1..125: mol_type = genomic DNA

SEQ ID NO: 126232 - DNA, 262 bp, Homo sapiens; identical to SEQ ID NO: 95955
  misc_feature 1..262: note = chr6:86160146-86160408
  misc_feature 1..262: note = Hyper
  source 1..262: mol_type = genomic DNA

SEQ ID NO: 126233 - DNA, 77 bp, Homo sapiens; identical to SEQ ID NO: 40856
  misc_feature 1..77: note = chr6:86302345-86302422
  misc_feature 1..77: note = Hypo
  source 1..77: mol_type = genomic DNA

SEQ ID NO: 126234 - DNA, 30 bp, Homo sapiens; identical to SEQ ID NO: 40857
  misc_feature 1..30: note = chr6:86415082-86415112
  misc_feature 1..30: note = Hypo
  source 1..30: mol_type = genomic DNA

SEQ ID NO: 126235 - DNA, 84 bp, Homo sapiens; identical to SEQ ID NO: 95958
  misc_feature 1..84: note = chr6:87646860-87646944
  misc_feature 1..84: note = Hyper
  source 1..84: mol_type = genomic DNA

SEQ ID NO: 126236 - DNA, 363 bp, Homo sapiens
  misc_feature 1..363: note = chr6:87647217-87647580
  misc_feature 1..363: note = Hyper
  source 1..363: mol_type = genomic DNA
ccgctctctccctctcgcctcctcttccagtccaggcgcccagactcggcgaagcgcagcgcctgccaccagcggtgcctcgggctgcccggcgcgccgcgctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggtgaggggcgcacaccttccgggacgaccttggcttccc

SEQ ID NO: 126237 - DNA, 27 bp, Homo sapiens
  misc_feature 1..27: note = chr6:87770042-87770069
  misc_feature 1..27: note = Hypo
  source 1..27: mol_type = genomic DNA
cgcaagaggctacgttttccattccaa

SEQ ID NO: 126238 - DNA, 761 bp, Homo sapiens; identical to SEQ ID NO: 95963
  misc_feature 1..761: note = chr6:87861548-87862309
  misc_feature 1..761: note = Hyper
  source 1..761: mol_type = genomic DNA

SEQ ID NO: 126239 - DNA, 2159 bp, Homo sapiens
  misc_feature 1..2159: note = chr6:88875382-88877541
  misc_feature 1..2159: note = Hyper
  source 1..2159: mol_type = genomic DNA
cagctaagtaaacaccgacgcacgattcgctcacacggaataagaactccacgaaggacacttggggaccacactggtcgtacccgagggggcgggaggcggaaaaagtatttccaaacgcaactctgccaggtcttacccttcgcatcccctggtcctcgggacagaagctcccttggcacctctcgcccagctcaggggctggttgtccgctagaacgaaatatcccccactgactacggagagctctgcagggagccgaggcccccgcccgggccaagggaaggcgctggcgccgcgggagacaagaagaggcggaggcggaaaagaagtggagaaggaaggggtggcagagggagtagcgtgcgggaggcggcgccggcgccgggctgctggcgaggcggggtggggtggagtggggtgtgcctccggcgggcggtcagcaagtcagtccgtccgagcgccggcgtcccggtctccagcgcccgcccgcgacagcgaccgggactggcgccccgctgctccgaccgccggcgagcctcgccccttcccaggctcttcactgggtcctcccgcgagccccgcctggcccggcgtggggccgcccgtctccgccagcccgggcgcccgtcgcctcgtcccgctcgcgcagtccctgccgctccctccgctcgcgctgtctctggctccctctcgctccagtcccatttatgaagcgcggtcccatcacgtgttaatgagcctttgtcctgccctggcagcggcggcggcacagaccccgccgagggaactgcgcggggagggacctgagcgcagcgcccgtagccccaaactttgcttggggcgggggacccgccgcggcgccagccctggggccagaggggacaagcctcttcggcccgcgtcacctacttctcctcttcctcctcctcctccgccgccgcgctcccggaggcccccgctgccatgacctcgctgtgctcccggataccctcacaccctgaccaggccaagaaggggctggtgcatgcgccgcccacgacctcggggccattaatcacacgctcccgggcagcgcgcatcgccaacaccttccgcgggggtcacgtctggggcagcgggctgagccggaaggggaaggggagcgggagcccagaggccgaggcgcgccgggcccgggggtgcggtctcgcgccccctccctccgcgcaaggccgctcccgtggcaggcggcagcgagctgggcccggggccgggctgagctttgggaccgcgctgcgcagcccccgagccgttcgctacctggctgcggtcgcgcggccacctgtcctccgccctcggggcgccgcccagcttcgcgccaggcgccttctccagcgcccgccgccctttcccggcgagaccactcgggcgcgccccgcccgccggtccccgatgcaaacagttgggctccgtaggcggctggctccgcgcctcccggcccggcgcgccccctccccggccacccggggccccgctcctcgcaccttttcgctggaggaggacgccccactccagggccggactgggggctctgggactcgggggcggcagcggcgggcgcctggggagccgcggtgtgctcagcagccgcggcaggaattaggggacatgctcgttaattgtttccactatcagccgccgtctgcctcctgtgtgcacggatcaaaccttaattggtctttacatttatcatggtgaattgcgaacctccaaacaagcctgggccgccgcttctgccgaggaggcgctcccctcccctccgcccccggggccctgcagggtgtgcggcggcggtcgtggttatttagacatctttatctctcgtgagttggatcgggagaggatcgcacggtttccacctgacggagccacgtcacgtcggccacaagggccccgtgctgggcgctgggttcggttcccggccgtcctcttgtggccgccttggcgttcattttatgacaccttgccggtgttcccagacatcatcccgcaccgctccgttttaccgacctccaggtcttcccgcccctgatcagaccccaacagcaaccgtactatatctggaccctatatttgaactacgtggtgagaatctgtgaaagcgagcctctcaggga

SEQ ID NO: 126240 - DNA, 37 bp, Homo sapiens; identical to SEQ ID NO: 95971
  misc_feature 1..37: note = chr6:88982725-88982762
  misc_feature 1..37: note = Hypo
  source 1..37: mol_type = genomic DNA

SEQ ID NO: 126241 - DNA, 49 bp, Homo sapiens; identical to SEQ ID NO: 95972
  misc_feature 1..49: note = chr6:89792319-89792368
  misc_feature 1..49: note = Hyper
  source 1..49: mol_type = genomic DNA

SEQ ID NO: 126242 - DNA, 48 bp, Homo sapiens; identical to SEQ ID NO: 95973
  misc_feature 1..48: note = chr6:89827453-89827501
  misc_feature 1..48: note = Hyper
  source 1..48: mol_type = genomic DNA

SEQ ID NO: 126243 - DNA, 48 bp, Homo sapiens; identical to SEQ ID NO: 95974
  misc_feature 1..48: note = chr6:89827745-89827793
  misc_feature 1..48: note = Hyper
  source 1..48: mol_type = genomic DNA

SEQ ID NO: 126244 - DNA, 120 bp, Homo sapiens; identical to SEQ ID NO: 95975
  misc_feature 1..120: note = chr6:89849217-89849337
  misc_feature 1..120: note = Hypo
  source 1..120: mol_type = genomic DNA

SEQ ID NO: 126245 - DNA, 20 bp, Homo sapiens
  misc_feature 1..20: note = chr6:89849397-89849417
  misc_feature 1..20: note = Hypo
  source 1..20: mol_type = genomic DNA
gcccgcgtggcagagcaaga

SEQ ID NO: 126246 - DNA, 85 bp, Homo sapiens; identical to SEQ ID NO: 95977
  misc_feature 1..85: note = chr6:89857318-89857403
  misc_feature 1..85: note = Hypo
  source 1..85: mol_type = genomic DNA

SEQ ID NO: 126247 - DNA, 120 bp, Homo sapiens; identical to SEQ ID NO: 95978
  misc_feature 1..120: note = chr6:89857583-89857703
  misc_feature 1..120: note = Hypo
  source 1..120: mol_type = genomic DNA

SEQ ID NO: 126248 - DNA, 417 bp, Homo sapiens; identical to SEQ ID NO: 95979
  misc_feature 1..417: note = chr6:90120876-90121293
  misc_feature 1..417: note = Hyper
  source 1..417: mol_type = genomic DNA

SEQ ID NO: 126249 - DNA, 87 bp, Homo sapiens; identical to SEQ ID NO: 95980
  misc_feature 1..87: note = chr6:90121597-90121684
  misc_feature 1..87: note = Hyper
  source 1..87: mol_type = genomic DNA

SEQ ID NO: 126250 - DNA, 30 bp, Homo sapiens; identical to SEQ ID NO: 95981
  misc_feature 1..30: note = chr6:90122393-90122423
  misc_feature 1..30: note = Hyper
  source 1..30: mol_type = genomic DNA

SEQ ID NO: 126251 - DNA, 826 bp, Homo sapiens; identical to SEQ ID NO: 95982
  misc_feature 1..826: note = chr6:90142902-90143728
  misc_feature 1..826: note = Hyper
  source 1..826: mol_type = genomic DNA

SEQ ID NO: 126252 - DNA, 30 bp, Homo sapiens; identical to SEQ ID NO: 95983
  misc_feature 1..30: note = chr6:90349357-90349387
  misc_feature 1..30: note = Hypo
  source 1..30: mol_type = genomic DNA

SEQ ID NO: 126253 - DNA, 239 bp, Homo sapiens; identical to SEQ ID NO: 95984
  misc_feature 1..239: note = chr6:90367251-90367490
  misc_feature 1..239: note = Hypo
  source 1..239: mol_type = genomic DNA

SEQ ID NO: 126254 - DNA, 30 bp, Homo sapiens; identical to SEQ ID NO: 95985
  misc_feature 1..30: note = chr6:90596072-90596102
  misc_feature 1..30: note = Hypo
  source 1..30: mol_type = genomic DNA

SEQ ID NO: 126255 - DNA, 94 bp, Homo sapiens; identical to SEQ ID NO: 95986
  misc_feature 1..94: note = chr6:90644578-90644672
  misc_feature 1..94: note = Hypo
  source 1..94: mol_type = genomic DNA

SEQ ID NO: 126256 - DNA, 185 bp, Homo sapiens; identical to SEQ ID NO: 40861
  misc_feature 1..185: note = chr6:90661223-90661408
  misc_feature 1..185: note = Hypo
  source 1..185: mol_type = genomic DNA

SEQ ID NO: 126257 - DNA, 30 bp, Homo sapiens; identical to SEQ ID NO: 95988
  misc_feature 1..30: note = chr6:90995490-90995520
  misc_feature 1..30: note = Hyper
  source 1..30: mol_type = genomic DNA

SEQ ID NO: 126258 - DNA, 941 bp, Homo sapiens
  misc_feature 1..941: note = chr6:91004761-91005702
  misc_feature 1..941: note = Hyper
  source 1..941: mol_type = genomic DNA
tgcagcactagacagcgaaggtgaaaaccaggaacgccgcgtctcgccgcccgcgggcccgccgggagactgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccctcgtgggcacctagggtagcccgtgagcgccgcccgccgccgtctccagcggcgccgggctcccgaacacccgccgggtgagcgaagcacagcggggccacggagcgcctcgacgcggggacggggagggcagtgtccccttcataaaccagtctcctgggtgaagcttctggggcttggagactggagtgtagggtgtgtgtgtgtgtgtgtgtgtgtgtgtgttgcaccttgacttcatggaggatctgtgggagaggaggtgcaaggtttccctctcagaagcctggcgcccttaggtcttagctacgcgggacgctttccgacaacccgatctttcgctaggagagattcgatccaggtctgcgccgcgaggcccccagctcgcctcttcctgcgaccctaaacttgggctttgattccccgccggtcgcggtggtccgggccacccggcggcggctgacagctgagcgcaaaggcgccgcggccaaggtcctcgcggagcagcccgggatgcgcacgcc

SEQ ID NO: 126259 - DNA, 1010 bp, Homo sapiens; identical to SEQ ID NO: 30644
  misc_feature 1..1010: note = chr6:91320285-91321295
  misc_feature 1..1010: note = Hyper
  source 1..1010: mol_type = genomic DNA

SEQ ID NO: 126260 - DNA, 1006 bp, Homo sapiens
  misc_feature 1..1006: note = chr6:94126125-94127131
  misc_feature 1..1006: note = Hyper
  source 1..1006: mol_type = genomic DNA
gtgaaataaacattgcgagattactgtttattgccattctgctacccctcagctcagcctgggggtggaagcaagggacctaagcagacagcagtgatggccaagttaagagagaaacaaactaacaaattaaaacaaaacagaacccggcccgagaacgtttaatcggaagccgctctcaagtgatccgtgcgtctctcttctgctcggtccgctctctggttaaaccctcaaaagagcgcgtatcccttcccgctcggagcagagtgccgacctccctttgcgcccgcggaggcgcagtccctcggctcacccggacgctgggggccaggcctaggactccagggctccgcgccccggagtcctgtgggccaacaggtgatgggagaggggctagactgggggcgcgccctgacagacccaggcaacgaccgcgcgggcaaaggctggcgtcccggggctggggcggggccgtcggaggggcggggcgggggctgccagacgggcgcgccagccgcgccaagcatccattacgcctctgccagacctgggcactccagggagccggtggcgccctcgctcgagaaggagtcgggaagaggagagtggctttcgggaagaggagagtggctttcgggaagcatctcctctgaggaagaggcggcggcggcggcggcatttacggagagaaaaagtaagcagctgcactttgccttcaagcgtcagactctgacacgcgctccctgtagcgatgataactgaccaacccgagagaacgtgcacaaggaaagtgagggaagggggtttcttatcttcctctagccacccccaaatgccccaggaggcccggcacctgcttcaagcggttcccagcgctagcccttgggtactgcgggccgcctcggggcttgtgaactcctagaacgccagctcttggtcgccgctgcgccctagaggcgtcgccgcctagaagccgggcgcactcgccgcccgccagccacagatc

SEQ ID NO: 126261 - DNA, 580 bp, Homo sapiens; identical to SEQ ID NO: 95997
  misc_feature 1..580: note = chr6:94127417-94127997
  misc_feature 1..580: note = Hyper
  source 1..580: mol_type = genomic DNA

SEQ ID NO: 126262 - DNA, 477 bp, Homo sapiens; identical to SEQ ID NO: 95998
  misc_feature 1..477: note = chr6:94128430-94128907
  misc_feature 1..477: note = Hyper
  source 1..477: mol_type = genomic DNA

SEQ ID NO: 126263 - DNA, 717 bp, Homo sapiens
  misc_feature 1..717: note = chr6:94129167-94129884
  misc_feature 1..717: note = Hyper
  source 1..717: mol_type = genomic DNA
ccccttctcggtccccgatcggctgctccacgtttagctttttttaatttcccccccactcctgttcgctcgcaccgtgtttgctgcctgcaagtctccgactgcagaccggccgcttgctccacactccaataatatcaattagggggggagggggcggggctccgagctgagagcctccgccactcgggctgagtggcaggcacagccggcctgccaggaggcgattcccagggccaaggggcgggtcccggcgaaatggccgccccggccacgggggcggggtccgaggcaggagccaatcggtgccgagcggagtcaggttgctggtccaggattccctccaggttctgagctcgcgctggatgttcagaggagaacgaggatggtagccgaggtgtgtgctgctttggacgctctgcttttagcaaccgcagctttcgcgtagcagaataaatccgagaataacgctcccaacttacactcttttctatagctgtactccgcgcgatcttttagaaaccagaggcgaagcaagccttctctcagctaccaagcacggagcccggacagtgaaatgagctgtgcctttaagtaaagtgtgttttacttttttgttgttagaacctccgcgggctgggtaactttgttttttgcctttttgaaaagtttctacttctctttttctgttactccaagagccgtcagttttaggta

SEQ ID NO: 126264 - DNA, 691 bp, Homo sapiens; identical to SEQ ID NO: 96001
  misc_feature 1..691: note = chr6:96463169-96463860
  misc_feature 1..691: note = Hyper
  source 1..691: mol_type = genomic DNA

SEQ ID NO: 126265 - DNA, 122 bp, Homo sapiens; identical to SEQ ID NO: 30653
  misc_feature 1..122: note = chr6:96464082-96464204
  misc_feature 1..122: note = Hyper
  source 1..122: mol_type = genomic DNA

SEQ ID NO: 126266 - DNA, 38 bp, Homo sapiens; identical to SEQ ID NO: 96003
  misc_feature 1..38: note = chr6:96464457-96464495
  misc_feature 1..38: note = Hyper
  source 1..38: mol_type = genomic DNA

SEQ ID NO: 126267 - DNA, 38 bp, Homo sapiens; identical to SEQ ID NO: 96004
  misc_feature 1..38: note = chr6:97285806-97285844
  misc_feature 1..38: note = Hyper
  source 1..38: mol_type = genomic DNA

SEQ ID NO: 126268 - DNA, 24 bp, Homo sapiens
  misc_feature 1..24: note = chr6:97299307-97299331
  misc_feature 1..24: note = Hypo
  source 1..24: mol_type = genomic DNA
gtgagactccgtctcaaaaaaaaa

SEQ ID NO: 126269 - DNA, 30 bp, Homo sapiens; identical to SEQ ID NO: 96006
  misc_feature 1..30: note = chr6:99164434-99164464
  misc_feature 1..30: note = Hyper
  source 1..30: mol_type = genomic DNA

SEQ ID NO: 126270 - DNA, 1176 bp, Homo sapiens; identical to SEQ ID NO: 96007
  misc_feature 1..1176: note = chr6:99271691-99272867
  misc_feature 1..1176: note = Hyper
  source 1..1176: mol_type = genomic DNA

SEQ ID NO: 126271 - DNA, 30 bp, Homo sapiens; identical to SEQ ID NO: 96008
  misc_feature 1..30: note = chr6:99273084-99273114
  misc_feature 1..30: note = Hyper
  source 1..30: mol_type = genomic DNA

SEQ ID NO: 126272 - DNA, 280 bp, Homo sapiens; identical to SEQ ID NO: 96009
  misc_feature 1..280: note = chr6:99273322-99273602
  misc_feature 1..280: note = Hyper
  source 1..280: mol_type = genomic DNA

SEQ ID NO: 126273 - DNA, 53 bp, Homo sapiens; identical to SEQ ID NO: 30658
  misc_feature 1..53: note = chr6:99273848-99273901
  misc_feature 1..53: note = Hyper
  source 1..53: mol_type = genomic DNA

SEQ ID NO: 126274 - DNA, 93 bp, Homo sapiens; identical to SEQ ID NO: 96011
  misc_feature 1..93: note = chr6:99275537-99275630
  misc_feature 1..93: note = Hyper
  source 1..93: mol_type = genomic DNA

SEQ ID NO: 126275 - DNA, 167 bp, Homo sapiens; identical to SEQ ID NO: 96012
  misc_feature 1..167: note = chr6:99275841-99276008
  misc_feature 1..167: note = Hyper
  source 1..167: mol_type = genomic DNA

SEQ ID NO: 126276 - DNA, 50 bp, Homo sapiens; identical to SEQ ID NO: 96013
  misc_feature 1..50: note = chr6:99276380-99276430
  misc_feature 1..50: note = Hyper
  source 1..50: mol_type = genomic DNA

SEQ ID NO: 126277 - DNA, 77 bp, Homo sapiens; identical to SEQ ID NO: 96014
  misc_feature 1..77: note = chr6:99276704-99276781
  misc_feature 1..77: note = Hyper
  source 1..77: mol_type = genomic DNA

SEQ ID NO: 126278 - DNA, 21 bp, Homo sapiens
  misc_feature 1..21: note = chr6:99277180-99277201
  misc_feature 1..21: note = Hyper
  source 1..21: mol_type = genomic DNA
tagggggagaaaatgcgagcg

SEQ ID NO: 126279 - DNA, 141 bp, Homo sapiens; identical to SEQ ID NO: 30662
  misc_feature 1..141: note = chr6:99277261-99277402
  misc_feature 1..141: note = Hyper
  source 1..141: mol_type = genomic DNA

SEQ ID NO: 126280 - DNA, 201 bp, Homo sapiens; identical to SEQ ID NO: 30663
  misc_feature 1..201: note = chr6:99278897-99279098
  misc_feature 1..201: note = Hyper
  source 1..201: mol_type = genomic DNA

SEQ ID NO: 126281 - DNA, 2142 bp, Homo sapiens
  misc_feature 1..2142: note = chr6:99279350-99281492
  misc_feature 1..2142: note = Hyper
  source 1..2142: mol_type = genomic DNA
agaatggcaggcagacgcgcggactctgccctgacagggtcagcccaaagaatgggccccagagcccggggcgggggaggaaccggtggagaggccccagtctggacctaaaaccagcgagagctcaggtttcgggagccccgaagaggtgccgcgctgggaggcagacaaggaagcccagggtgctcggaacccggcgttcgcgccaaccgggcccctggcgcctggaggggaggcggcggtagctcgtggggaggtgttgctcagagccgcggtgcgagcccagcctggcccgcccggtgattggccgcgcttgggggtgggggtggggtgcagagactgaggccccgggtaggctatttctttgtgtactcccggggatttattgggtatattaaaccctgttgggaacgtttcggctccttggccgccagcgaaatgagacggggatggaagttggagttgagacctgggaagtcaacgtgggaaggatctcagcattaatcgccggtgatgtcctatcgcagacaggaagttttgatgtacacgtgcagcctattcttgtcccctcacactagcgccctatgccgggaggagggcgggggtgtggggtggggtgtggagagaaagataagaggaggaggaacttttaaattgattcagagccaggccgcctcagttccttcgaagatgtgtttgaaaacttcattcttctttcgagtgtatcatcctatgggctgcagaaggccttgtgcctcgagaaatgtgaaattaaatccagagaaaagcagacacctgccccagaaaggtgggggagaagtatgagctgcttagcacttggacgcggcccttccccagggctggattcttctgtccgtgggagctctgagctccaggtccgcgaaaagaaaggcacgacatgtcaggagaagatgcggctggcgggctgtctgtgcgctccccaaggcccagggaaagtcacgcgcctagcacaggggacgcagggccgaagccgggagaaggcggttctgcccgccacccagccccttggctcgcggttgcggagccgcgggcaccagtcgctgagtctgcgcgctgaggctcggacttgttcattttttcctagctagacaaagttatgggattcctagcagcccccaggcgcgcggccagagtggccccgcgcttgcgctgggacggagcgacacgctgtgtgtgtcctcgcctcgcctcgccgcgcgggtgcgcgcgtggtgggggtgcaggtccgtcctgctggcggcctgtgggctcgcccctcccctatccatttctctcccccacacacgctcataaacacaggacacgtggaaattctcagccaaagcgtcttgcccgggcgggtgctcaacgtggtgatttataaacagctcagccactctccaaagagcatgactccttgttagtcatgatgaattttctggcccgctccagtctgctgtctggattcagatgctcagaggccccaaaatgctccctctgagcgttgatttggctgccctctcaagcctacgaccgccggcaaaaccagcgatagagcgaggggtgagaggtggggacgcgatccaggttccctggggtctgtcattcccttcccggcagtaactgttgattcgctttacagcgcccatgtacacacccggccctgcgtggcggtcacgccgctccagcctgggtccgcgcccaagttctagctaccgggcttgcaggctcggaaactcgcaggcggcacctgctctgggcggctaaagaactgatggcgcgacgcgcccgcgctccgtagagcggcgctgcgggtgcatggtcccatagtcttgctctggagttcactgctgaaagctgagctgggagcttggccagggagcgccaaagacatagactaaccccacccgctagcgcccaccgaagttactgattaggaaggttcccctggcatcagcccatttgcttcacacactcttcctccttcccaaggggctaacggaaaagttgcacctaccagcggtaggagcacggggaatcgcgcacgcaggccctccgcgcggcttcccggagcggcctttggcgactgcgccgcccctacaaggccgcacacccctcgcc

SEQ ID NO: 126282 - DNA, 207 bp, Homo sapiens; identical to SEQ ID NO: 96021
  misc_feature 1..207: note = chr6:99281846-99282053
  misc_feature 1..207: note = Hyper
  source 1..207: mol_type = genomic DNA

SEQ ID NO: 126283 - DNA, 41 bp, Homo sapiens; identical to SEQ ID NO: 96022
  misc_feature 1..41: note = chr6:99282531-99282572
  misc_feature 1..41: note = Hyper
  source 1..41: mol_type = genomic DNA

SEQ ID NO: 126284 - DNA, 302 bp, Homo sapiens; identical to SEQ ID NO: 96023
  misc_feature 1..302: note = chr6:99282778-99283080
  misc_feature 1..302: note = Hyper
  source 1..302: mol_type = genomic DNA

SEQ ID NO: 126285 - DNA, 702 bp, Homo sapiens; identical to SEQ ID NO: 96024
  misc_feature 1..702: note = chr6:99283339-99284041
  misc_feature 1..702: note = Hyper
  source 1..702: mol_type = genomic DNA

SEQ ID NO: 126286 - DNA, 30 bp, Homo sapiens; identical to SEQ ID NO: 30673
  misc_feature 1..30: note = chr6:99284652-99284682
  misc_feature 1..30: note = Hyper
  source 1..30: mol_type = genomic DNA

SEQ ID NO: 126287 - DNA, 375 bp, Homo sapiens
  misc_feature 1..375: note = chr6:99290280-99290655
  misc_feature 1..375: note = Hyper
  source 1..375: mol_type = genomic DNA
gggcgagtgtgctgccggccaacatctgctccttgcccagtcgcaaaagaggtaccttggccttgccgcgcaccccccacctcggggaccctggccgctgtcgcgaaggcccagacagcctagctcggccgcgcggggaggagagagacagggaaaggagcggggcactccctgcactcccagccccggccttcgctcgggacgctgccaacagcccctgagttcctgcctggaaatcagggattctctgcggctccccaggcttcgacgcccggacccccaggggaagggtcaacagctcggacgtcgagctgttccactctatcgcttcccaaggaagcgggctaggggtaacgggcacggttggtgggtttg

SEQ ID NO: 126288 - DNA, 650 bp, Homo sapiens
  misc_feature 1..650: note = chr6:99291285-99291935
  misc_feature 1..650: note = Hyper
  source 1..650: mol_type = genomic DNA
accctctgggcaccccggcatctcaagccagagctgagggcccggaaagtgaggggccgcgcctcagtactggaggcctagagtccatctccgcgaactgggggctctcagggcccgcagaaatcccccttagccctccgaggcccctggaaggagtcgccccgggagaggaaatcactcagctctgaaaagcgtcgcaaacgggcggtgggagagttctaaagcggcctttcgcctctcggaggaggtgaggccgagctggggatgtgcgggtttggggcccagaactgcaccgcagggccgcagaggcgggaagctggccggagaggagtgggaaggcgaccaagggcagcagcaggggctcctgcggggcgcaggtctgtgctggcgccgggcctggcctctgcaggctcggcggagcctcccgattgctcccgccgcacccgcccgcggccactcacccggccccgcggccagcccgggcggggtcgcacgcaaacaaggatgcttctatttactcgcctctgcctgtagatttctaagacattcagcaggcacaatcattaaactaatttgtgtttgattgtttgggcggacggagggtagttttattgcgctaagcattcaagcaggcacgcatcgctgattac

SEQ ID NO: 126289 - DNA, 318 bp, Homo sapiens; identical to SEQ ID NO: 96030
  misc_feature 1..318: note = chr6:99292203-99292521
  misc_feature 1..318: note = Hyper
  source 1..318: mol_type = genomic DNA

SEQ ID NO: 126290 - DNA, 30 bp, Homo sapiens; identical to SEQ ID NO: 96031
  misc_feature 1..30: note = chr6:99293257-99293287
  misc_feature 1..30: note = Hyper
  source 1..30: mol_type = genomic DNA

SEQ ID NO: 126291 - DNA, 875 bp, Homo sapiens
  misc_feature 1..875: note = chr6:99295649-99296524
  misc_feature 1..875: note = Hyper
  source 1..875: mol_type = genomic DNA
tccacacacgcctcccgtctagagagccccagtggcccagggccacctccagtccctggacttggaaatcaggacgctgtggatcccacaggcgccccgcgacatcctggagtcgccgggagtggcgctgcggtgaaagccggtgcctagagtgggcttaggggtcccattccactcggaaagtcctctcacctccccaagggccattctgccggcgcaatgtgggggtccctccgccactcgagcagagcctgcctaggccaggcacccctttgggtgagagcggagggcccctgggacgcccagccaggcctggcgtctggggagccggggctcctgtgtgtgtcgggcaggctccgatggccgaagcagggacgaaggaacggcttcgctgcgggaggctagagggctgcgcttccgccctcccggcctccctcttgccgcatgagcagcgcagggcctcctgggctgtgctggggtcaagagttatgaacacttcgtgtcctcaggagctcacgggggtgacgagaggcggtctgggtctgaagccgctacacagaggggagcagtggggcctcggggagcagcggggcctcggcttggcggctccccccgccaccccgccacctttcaggacccaggccaagccgcctcacgaagaccaggaagcggcctctgccgggaagccacctgcagcctatagtcccctccccaagcggccccagcccgtgctatctcctacatagttgccttccgaacgcctggagggccctgacccttccggtgttccaccgcaatggggtcggggggagaggggggctgtggctgcctgagacctccagggcagcgcacattacgggcgggaaagggaagtc

SEQ ID NO: 126292 - DNA, 149 bp, Homo sapiens; identical to SEQ ID NO: 40863
  misc_feature 1..149: note = chr6:99396329-99396478
  misc_feature 1..149: note = Hypo
  source 1..149: mol_type = genomic DNA

SEQ ID NO: 126293 - DNA, 29 bp, Homo sapiens
  misc_feature 1..29: note = chr6:99396718-99396747
  misc_feature 1..29: note = Hypo
  source 1..29: mol_type = genomic DNA
tgagccaccgcgcccgcccttggcacttt

SEQ ID NO: 126294 - DNA, 30 bp, Homo sapiens; identical to SEQ ID NO: 96037
  misc_feature 1..30: note = chr6:99797154-99797184
  misc_feature 1..30: note = Hyper
  source 1..30: mol_type = genomic DNA

SEQ ID NO: 126295 - DNA, 30 bp, Homo sapiens; identical to SEQ ID NO: 96038
  misc_feature 1..30: note = chr6:99961087-99961117
  misc_feature 1..30: note = Hypo
  source 1..30: mol_type = genomic DNA

SEQ ID NO: 126296 - DNA, 70 bp, Homo sapiens; identical to SEQ ID NO: 94446
  misc_feature 1..70: note = chr6:100036662-100036732
  misc_feature 1..70: note = Hyper
  source 1..70: mol_type = genomic DNA

SEQ ID NO: 126297 - DNA, 201 bp, Homo sapiens; identical to SEQ ID NO: 94447
  misc_feature 1..201: note = chr6:100036959-100037160
  misc_feature 1..201: note = Hyper
  source 1..201: mol_type = genomic DNA

SEQ ID NO: 126298 - DNA, 834 bp, Homo sapiens
  misc_feature 1..834: note = chr6:100038640-100039474
  misc_feature 1..834: note = Hyper
  source 1..834: mol_type = genomic DNA
tgccttccttcccctcgtcgccttcctcccactgtgcgagcttcggaaccctaaggccggttcactgcgcattgtccccgacaagttagcagcgctccccgaggggtgtgaggcaccaggtagggtgcagggcgcgagcgcggggcggtggtgcccggcgggggtggggtgcccacggacgcagccgcctagctctgccggccgtcctgaggcagctgctggcgcccgccgggaggcgcgtggccacttgcacttcagcgcgcggttctctctccgcaggctgctttctaggatttgaaagggccatagcgacagaagtcgatctctaagaaggcataaactcggcctgagacgtgggggggagacactgcagagaagaggccaagttccagcgcagaaggggggttccgcggggccctgggattgaggagacaggagcgagccttccctttccgtcctctcaggaaaacagcctgacctgctggcacgtccacccccaacagaagagggaccccggcgcggcgtccttaccatccccatcccccgacccctgaggaagccagggctctcttctttccctgggcgcctgtcacaggggcagaggctgggcctcgagcttttctgcacgtgagctcggtggtccagcagagtcttctggctcccgggaaagcagcgtggcgccgccccagcccccagtccccagactagggattgggacgtcagtcattggctgcaggttactggtctgggctgggcccgcagagatcccaagcgctcctctgtcggtgcttcctcagcgtctgcgtttccgcagatgcccgaggtcagacagtt

SEQ ID NO: 126299 - DNA, 184 bp, Homo sapiens
  misc_feature 1..184: note = chr6:100050341-100050525
  misc_feature 1..184: note = Hyper
  source 1..184: mol_type = genomic DNA
agaacacctttatttcgccttttaactctccgcctttctgattaaagagttcagacctgctccccggcccgcgttcaattattccccagcatcttttctcagaagctgtcaccaccacttgcggaaccgcagcctcatcgtgagccattagcccagttgtttcccgtttcgcttttctttcctc

SEQ ID NO: 126300 - DNA, 1397 bp, Homo sapiens
  misc_feature 1..1397: note = chr6:100050754-100052151
  misc_feature 1..1397: note = Hyper
  source 1..1397: mol_type = genomic DNA
aacagcaaggaaaatcgaattgagtgcgggctcattcggcagcggccggcagagaagcgctgaatgtggaggtgccccgagacattgcaattcagcaacacgctcgctgacttttctttgcaccatgtcaaccgaaagaaccaagaaataagttggagaactccggttaaaaggcaacttgagagggattctgaatacttttattgagccgtttccaacggaggacttaaaaaacaacaaaaaaggcaccacaaaacccaccagcggcgtccgggctgcgtcctggctgccactttggagcctcccggccgccgcgcatccaccggccatgcaattaaggggaaaatggcctcatcgccggcgtgtcatctggtggcgttcccagagcccatcgccgccgccctattcagacccggccttaatgtcccacccgcgcctcgggggccgcgcagctggtccaagctgacccgcccgcccggccagcgcggacaccctcggggggtgcagcccaggccacctcaggccaaaattcggctactgaaagcggggcttgcaggactctctctgctttccctaacctccttcgcctcgggtctctgaccccgcgcggctctctgcatccccgggttcaggactcctccggccccagttttgggattccgcgttgacctaggagggaggggtgtttggtgagtcaccagcaccagggtctccaaggctgagcccgcctccccaacccccgggacaactccctcggtccccgtggggacctgaaactcaaggcctttgagcgacggtgacgagcagccccggagaagtgtggtctgaaagaagccgctcatctcagcctcaaagtcttaaggggctcctttcctctaggcggagccgagtcaggtcacacgtgctcggcgccggccgcattcccagctcttcgctcattcgcgactatgcgccaggcggggccgccccctaacgctgccgggttcgaaagccgcccgcgggtgggacttagctctccgtagcctgcctctcggagggccggcggctgctggtgagcattccagcctcgttagggcaacctgttaccggagagggagccttgcccgaacggttctactgtgggcagggagcaggaccgcccctaaaccgcctttccccgcacctcggtgtaggagagatttcgctttaacggagactctggacgcccatttcaagtcgataaaaaaaaaaaaaaagccgagtggaatgttttgattgagtctcaacattgtctttgaataaggctgagaccatgtaattaatgtgtctttttaataagggacaatacggccgttcaagctatttaatttcatttaattttccatcccatttgctgcacagcccgcttttacttttaa

SEQ ID NO: 126301 - DNA, 293 bp, Homo sapiens; identical to SEQ ID NO: 94457
  misc_feature 1..293: note = chr6:100052449-100052742
  misc_feature 1..293: note = Hyper
  source 1..293: mol_type = genomic DNA

SEQ ID NO: 126302 - DNA, 222 bp, Homo sapiens; identical to SEQ ID NO: 30693
  misc_feature 1..222: note = chr6:100053289-100053511
  misc_feature 1..222: note = Hyper
  source 1..222: mol_type = genomic DNA

SEQ ID NO: 126303 - DNA, 992 bp, Homo sapiens
  misc_feature 1..992: note = chr6:100054839-100055831
  misc_feature 1..992: note = Hyper
  source 1..992: mol_type = genomic DNA
tccagctctgtcactcgcgcccttccaaggacctggagcacccgagcgcctgcctggtggcggcggcaacaatgcacggagccgccagagcgccagccaccagcgtgagtgccgactgctgcatcccggccggcttgcgcctcggaccggtgcctggtaccttcaagctgggcaagtacctgtcagaccgcagggagcccgggcctaagaaaaaggtattgaccattcagacctctgcccactgccattcgcctctcagtgccctgacccgggaaaggggtacgagagaaagtggaggaagggagtgattgagtcgttacctgctaattctgccgggtggaaggggactcctattattctgagcaagtagcctctttaactgtgagagctggacggggtcgggctgagaggagaggatgtggccgagaggcgacagccctgggtggggtgcactgagcgctgtaggtgccgggaccattcgcagcttgtgttttcccctgcgctctcgggtctcctcagtcagaagccagaagcccacccccgcacgctgtccgcagctctctctgcaaaagcaccctctttctgggggctcagggcatcgagaccctttcttcccttctgcccttcaatatgttaatttgaggcctaatttcgccttaaagtaattttttttcctgaaaaaaaaaatctttgggaggctctcagttcctagaacctcctcagatatttttttttcccttgccgatgtcggcttgtgggtatgcggcatatggagagaggatgagcaaggtactggctctgacgcgggctccaagggcgaggcgcgcccattcgcgcggggcacagggtcagagcgtctgcagcggggctctgagagtccagaggcccaaccgggaggcgccagggccaaaccactagctttgactcccacactccacacaccgtcgcgacccctgaccagagagacttatagcactcgcccgctttggggg

SEQ ID NO: 126304 - DNA, 2113 bp, Homo sapiens
  misc_feature 1..2113: note = chr6:100060975-100063088
  misc_feature 1..2113: note = Hyper
  source 1..2113: mol_type = genomic DNA
cctgcgtttccactgcgtgttcagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccccggaagaggcgtccgccttcaagcacgtggagcgcgccccgcccgcagccgccgcgctgccaggagcgcgttatgcgcagctgccccctgcgccggggttgcccctcgagcgctgcgcgctgccgcccctcgacccgggcggtctcaaagcctatccgggtggtgagtgcagccacctgcccgccgtcatgccggcctttacagtctacaacggggagctgctctacggctcaccggccaccaccgcttattacccgctcaaattgcacttcggcgggctgctgaagtatccggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaacgagtcttcccgggaaggggcggggtgaggacagagaggagtcgagggtttattctcgcagtagaggaactcctggtggtgggaagagggacccaatggacaaaaccgtttttgtttttgagagggcgccagatttgaaacagtgagaggtcccacatctggtgctgaaactcagagcaacagttcagaggtggcgtaaatctggccacctggagagctcgagtgccaccagtacctccgcaccccgggcctctggacttcttggatgagctcaccctgaaccgcccaggcggtctgctcttggtgttcagaatcacatcaatgcgaacgtcacagcgccttcgagggcgcagattttaactgccacgtatttttaagttgtacttttctgtggaggaaattgtgccttttgaaacgacgttttgtgtgtgtatttcacgttagcatttcatt

SEQ ID NO: 126305 - DNA, 819 bp, Homo sapiens
  misc_feature 1..819: note = chr6:100066608-100067427
  misc_feature 1..819: note = Hyper
  source 1..819: mol_type = genomic DNA
tgagccgcgttactccgagcgctcccattggtgcattccttggagccagggttgctattggtggcgagctggccgcggcgaaagaaccccggccgcttgggctagtgcggcggcggccaggcggagccggaggtgagagtgcgagcagcgtcctgtggcgtggcgacccctgggctcacagcctcgcgctccctgggctcacagcctcgggctccctggactcacagcctcgccctccctgggctcacagcctcgcgctccctgggctcacagcctcgcgctccctgggaataggggtttctggggtcttgttggggcagaggtgcgggagtctcgccgcgtttaggtggacagtccaggagtcctgctggagaggaggacctgggaagacccgcgatgccggcaggaggacgggagagtttcaggcgtaactggtctttgtggaaaccgcccgaccccgctgtggaggggagctgcggcacccgcgccgtgcgctctcgccatctgccgccttcccaacgggaagagggcagaggcgccggcgccatcgcgaggtcaagcgtgacccttggccacccaggtgtgagttgtgaagaggaggactcatcagacggctgggccaacgtgtttagttccagaaggagcgtggcgctcgctctgggctcggcgacctccctacaaaagatgaaaggagggcttctgtcatatgcgactgtagtttaattcaaattaagccgttgtaccacagacaacttgttaatgcctttagcttgcaaaccctccaagagtccttcaaaaagggaccgaaagtgggtggac

SEQ ID NO: 126306 - DNA, 874 bp, Homo sapiens
  misc_feature 1..874: note = chr6:100441291-100442165
  misc_feature 1..874: note = Hyper
  source 1..874: mol_type = genomic DNA
aaggccgtccggaggcgcgtacaggggacacggggatctacctggaggaagaactgaatttgtcttttctagttcaaaaaagccttcccgaactcttagcaaacaagccagtgatcgcctcctcgccttcgccacttcagttcagcctctttagtccccatggagagccgggatgaactagcccggcgcgctccagcggtctcggtcggggccgctgcttcccggaaagccactccctttttcttttcccacctgtgtttccattttctttgccgagtgtgaaaccagccggccacccacccgccccgctccgtctcgtaggtgcctccacagagccaaactttgtaccttctggggatggagggggatcccccagcaatcagacactaccggcgagccagccccggggaggggcgactggtggaccaggcgccagaccttcccgggcgcgcagcccacgggccctggggcgcgcccacgccagagcccggccctcgcgcggcagcccgcgggacgtcacctgggtgctcgcgtcctccccgcgcggcggacagcccgggcgcccttcctctctgcgggactgcaggtctatccgctaagcgcgcgtgaccaaaaacggctctcagcgggtcccagctgacggaaggtgggggaggagtgcgagggtctctgagacaggttgggagccagccccacctccatttccaaagcgggggtccaggcacaggaacagccaaacgcccgaaccagcggggttacctttgccacttcatccaatccgagcatcgggtgcgtcgtgctcttttctaggagcgtggggtgccttcgcgaataaaatctgaaggcatctctgctctcgcggagcttgttcttt

SEQ ID NO: 126307 - DNA, 353 bp, Homo sapiens; identical to SEQ ID NO: 94470
  misc_feature 1..353: note = chr6:100729492-100729845
  misc_feature 1..353: note = Hyper
  source 1..353: mol_type = genomic DNA

SEQ ID NO: 126308 - DNA, 29 bp, Homo sapiens
  misc_feature 1..29: note = chr6:100902455-100902484
  misc_feature 1..29: note = Hyper
  source 1..29: mol_type = genomic DNA
ttttgtaatattttcgttctcatctctaa

SEQ ID NO: 126309 - DNA, 1228 bp, Homo sapiens
  misc_feature 1..1228: note = chr6:100903253-100904481
  misc_feature 1..1228: note = Hyper
  source 1..1228: mol_type = genomic DNA
ggggtcctcctggaccgttctggaagggcccccgccacagccacctgtacacaccccttggccttatcacatttatcgctcttcccctttcagccaacctattctccttcgtttctgtcacgacctgctcttctctttctaaatcccggctccgacatacccactcagaaggagtgacaggagggattggctgcggaggccacacgggggaaaggagaaaggaccctattgggaaagccgaggacgccggcgacgctggcccttgggcgctctggggcctacggaggccttaaaccccaaagattggcggggacgaagggccggggcactcgagcgagcctggagcgggcaaagactgcgttgcgactggggacaggtctcgcgcggttcccgaagggtgcgaagactgcgctgagcattttgaaggcctcccaaagcggctggaagacaccccgaagcggcctcccaaccagaatgatctgaaaatcccccaggctgggctcgggataaatactagttctgaactcccggcgccagcctaggccatttgttgtttcgggtttcggcctcattagtatgcgcctacgagggaaaatgagacttccccacaggttaataaacaacctgtccggcacaggttaacaggagcctctctcgccctctcctgccccacccccgccaccttttaaggaagcttttgccttcccggaggtttgccttctctttctgttccccgtagaaatcttacgattgtgtctgggttaatgttttataagggactggctactctcgtctacctgccgggctttcccgatctaatatcgaaggaacctccccaagtcctagtaaggggtcccccctccctaaagtctcgaagtggggtagagaccttctccctggagcccctcgcctcctgccttcggtgacgcgctctagcacacccaatttcagttggcgagggggtaagctgagatttcgtttctgcacttgacctaccgcagaaaattcgcaaatcctttgattgtctgtttaaaatgaggaggaaaccagctccctttgcggcgggattacagtgggaacaagatctaaagattctcttgcaattcggcgaggccgagggaacggggttttgcaaaagagaaaaggagctctgtgagggaggcgataactaaatcgggttttagacaaaaggattttcctcagctaaagtggccgaagacaaaggaaa

SEQ ID NO: 126310 - DNA, 41 bp, Homo sapiens; identical to SEQ ID NO: 94474
  misc_feature 1..41: note = chr6:100905267-100905308
  misc_feature 1..41: note = Hyper
  source 1..41: mol_type = genomic DNA

SEQ ID NO: 126311 - DNA, 92 bp, Homo sapiens; identical to SEQ ID NO: 94475
  misc_feature 1..92: note = chr6:100905783-100905875
  misc_feature 1..92: note = Hyper
  source 1..92: mol_type = genomic DNA

SEQ ID NO: 126312 - DNA, 391 bp, Homo sapiens
  misc_feature 1..391: note = chr6:100905935-100906326
  misc_feature 1..391: note = Hyper
  source 1..391: mol_type = genomic DNA
ctctctctctctgccttcgcggagctccagccctcgagtttgggcttcccgtagggatagagcctgcgggccaacctggctgcccgagttggagccagccgcgaaaagacggcagaaacccaaggagggcggggttcggccagactaaaactgggggcgaaattcatgcagcgttcatgagacagtcctgcgtgacggccgaaaaacgtcaatcgatgtcgccctgggactccgggtcttcgaatgcggcccagctttggctatgccacctccctagaggcccgcgctggcgaggccgagcccgaacgcgcgggcgaatcccacttaggttctacttggcgcagggactcggacgatggcacctaacccgccttcccgggaactgcccaaa

SEQ ID NO: 126313 - DNA, 1234 bp, Homo sapiens
  misc_feature 1..1234: note = chr6:100911997-100913231
  misc_feature 1..1234: note = Hyper
  source 1..1234: mol_type = genomic DNA
ctcacccatgccagccgcatcctccagacccctgggaagttgcccaaacaacaaaatacatatttctgaagacccgcaagggatcttccgccgcggatccccgagtccgcgcccaggccgggcgcacgtcccaggaaagcaggtttccgcaaatcagaattcctccaaggcgaggcaggggcctttcagctccctaccttggcagatctggaccttggctacctctttaacttgggtctcaagtctgagggattcctcaaaaagtgacacttacacaccaagtctctcgggactcccaaggcgacccagcgctctggctgcccagcaggggctgcaacaagcggggcccagcagcgccaggttaacaggtggcgcgctcgcgacagcccctcgcaggctcccccgggggtgggaggcgccgcggcctctcccacaccaccgcggagctgcggggctgctgggcgggcgcggggcgtcttctgcttcacctaccttcagtccccacaagcggcagaggtttcgggggcgcccatctcttaactgttctcatgcctaccgtccaacccagcgacaccgccggcctctccgcttcccaccggcagagaggagcagagcattcccggctcccttttctggatcatgaattggaggaggggtgcgtggcagaaagaggaggatgcaagctttgggacgagtgaggtgattttagaatcctggtcctccgtagttgctacgaagccagttcactattattcctaattggaagccgaaaactgccccccgtaacttctttatagcttaagggtttagcttcaacttcactccggggccgcctctctcccgccctccctcaatgccactcacaagccccctcgcctcccattggcctggcgcggccaggggcgaggcgctcattggccaatagggctgagtgacacgagtcggccccgagccgccctccgcgcgcccaggctccgggctctgaatcttactacccgcgggaccgctggactcctaatgagctcagggtgccgggtcggcgctgtccggttgccgccgctgctcgcggcctcctgggccttcccgacgtcgtgcgcgacccgcgctcctcgagctccctggggtcgggtggttgagcgctcagtccagcgcggcggcccagcagaaccgggaacgtccggaggcagcggaggtcgggcctgcgggttaggtctaccggcggaggaggcagggt

SEQ ID NO: 126314 - DNA, 30 bp, Homo sapiens; identical to SEQ ID NO: 94480
  misc_feature 1..30: note = chr6:100913748-100913778
  misc_feature 1..30: note = Hyper
  source 1..30: mol_type = genomic DNA

SEQ ID NO: 126315 - DNA, 958 bp, Homo sapiens
  misc_feature 1..958: note = chr6:100914823-100915781
  misc_feature 1..958: note = Hyper
  source 1..958: mol_type = genomic DNA
gtaaggaagtcttcacgcttaaggctgacgtcctggggggctgggcgggctgttccaatgtcccagtgaagctcagttgtcaatgagccaagtagatgtcgtttaataaacaaagtgaatgcacgaccacgaggtgacggcctctcgctaagtcctcagcacacaactgtctgagccgcgtttaccgagagagtgaattagcatgacgacgtaacacctgtttttctaatctttgaacctaggttggagccggaacgctgctccttcactccccctcccgggcccagggacctggctttgcaccctccccacgaccccgcctgccagccccccacgcgccctgtagccggaggcgtgaaccgtgaaccggaacctcaggtgcctcccacgtgttctgcgaatttacgttcgcctctagcacgggaaattttaaatgaatttcttgaagctcagagactaatcgttttgccaatataaggagaaaagccccagaaaggaagagacggtcacgggcgacccactaaccccaaatagagatccttatagagtctaggccgccacctccttgagccggtggccttaaaacctagcctctggccctcaggcacccagaatgcgatcctgatgtgggagaaaacccatgcggggctgcaaaaaagtgtctccctccttcccccaccaagcagggcgaacagcctagtgtgatggcgacactgttcccccaagagtccctgccacttctggggcaacccaggatgctgccctcatggagcctgccccggaccccggaggccaggacatgcaggcgtccgtgactctaccccaggggagccaggccgggtagattctggaaccaacgcgcctttgtgagcaatgtctagcatgccgcgcgcacccagaaagaagggggagcgggcacctcaagggccttctgacccctccccgcaaaaggcaaaat

SEQ ID NO: 126316 - DNA, 191 bp, Homo sapiens
  misc_feature 1..191: note = chr6:100917195-100917386
  misc_feature 1..191: note = Hyper
  source 1..191: mol_type = genomic DNA
aatccctgtccgaatcgggaattggcattccgtaagggagcggagggcctcaggccactaggcagctccgaacgcggggaagcgggagcaaagatgagctcagagcgagggttgccggcgccaccctgggctgcgcagtgaggggccgtggacccgccccgagactcagtgacagtcgcagcttaaccccg

SEQ ID NO: 126317 - DNA, 1433 bp, Homo sapiens; identical to SEQ ID NO: 94486
  misc_feature 1..1433: note = chr6:101840541-101841974
  misc_feature 1..1433: note = Hyper
  source 1..1433: mol_type = genomic DNA

SEQ ID NO: 126318 - DNA, 304 bp, Homo sapiens
  misc_feature 1..304: note = chr6:101847302-101847606
  misc_feature 1..304: note = Hyper
  source 1..304: mol_type = genomic DNA
ccgctcccaggcagccggatgtaaacaggcggttcgctctgcctggcggtgggctccgtggattctgatctgctcactgctctgtcgtctcctggggcttttaaagaactccttgtgctttcatttcttctcttctttatttttatttttagccgcgggagggtgaagggagggccaatgtgtggtagtggtctctgcattacctccccacagtagcttgccacggagatgatgatgacgatggaggcacggtcagccgccactcccgcctgtctcccccggcgccctgcgagcttggaggggt

SEQ ID NO: 126319 - DNA, 272 bp, Homo sapiens; identical to SEQ ID NO: 94487
  misc_feature 1..272: note = chr6:101849938-101850210
  misc_feature 1..272: note = Hyper
  source 1..272: mol_type = genomic DNA

SEQ ID NO: 126320 - DNA, 326 bp, Homo sapiens
  misc_feature 1..326: note = chr6:101850475-101850801
  misc_feature 1..326: note = Hyper
  source 1..326: mol_type = genomic DNA
tcttggttgtcaccccgcctttgatcctgtgttgggacaacttgggttttcctgggtgcccacccggcgggcaaggtgcattttagagagtcagttctcctgccctaggtcgagccagatgttctctggccggcttttctgggagcagagcctgcgactctcccaggcaggcgtctccagagcgctggcgcggcgggcacagggcatccagcgcgtcccagcgtatgtaaatgaggcatctttgtttcgccgcagctgcgtcccggccttgcccgccccaggatagggtgaaggcgggactcttccgtccgcgggggtgtgaccaa

SEQ ID NO: 126321 - DNA, 31 bp, Homo sapiens; identical to SEQ ID NO: 94489
  misc_feature 1..31: note = chr6:103355599-103355630
  misc_feature 1..31: note = Hypo
  source 1..31: mol_type = genomic DNA

SEQ ID NO: 126322 - DNA, 91 bp, Homo sapiens; identical to SEQ ID NO: 94490
  misc_feature 1..91: note = chr6:103355690-103355781
  misc_feature 1..91: note = Hypo
  source 1..91: mol_type = genomic DNA

SEQ ID NO: 126323 - DNA, 19 bp, Homo sapiens
  misc_feature 1..19: note = chr6:105143888-105143907
  misc_feature 1..19: note = Hypo
  source 1..19: mol_type = genomic DNA
ccaccgtgcctggccctcc

SEQ ID NO: 126324 - DNA, 40 bp, Homo sapiens; identical to SEQ ID NO: 94523
  misc_feature 1..40: note = chr6:105384637-105384677
  misc_feature 1..40: note = Hypo
  source 1..40: mol_type = genomic DNA

SEQ ID NO: 126325 - DNA, 80 bp, Homo sapiens
  misc_feature 1..80: note = chr6:105388314-105388394
  misc_feature 1..80: note = Hyper
  source 1..80: mol_type = genomic DNA
gcggcagcggccgtgcgcgcccacggcctgcgcggggacgcgcttcgggggttcgggggcgcccgcggtaaagctccacc

SEQ ID NO: 126326 - DNA, 1078 bp, Homo sapiens
  misc_feature 1..1078: note = chr6:105388632-105389710
  misc_feature 1..1078: note = Hyper
  source 1..1078: mol_type = genomic DNA
ggcgacagcggattccgtgcccggtggccgcgcgccgcccggctgttccgcgtccccttgccggctcacaatgtgctgaccctcccggccccgccgcgcgcctcacaggtctctcgacctccgcgctccctcaggaagtgacagactccaggccccttcctccgccccgtccttcgggactgaacgccacacacgtcctcacaccctctccccctctcacacccaggctagcgacgcgaccatgaggccccggaggtaagcagccggccccgcggccgcgcgagtgcgagcgtggccgggtgtgcgtgcgggtgcggacgccgctcgcggtcccgagtctggcacgtgagcaacgtcgaggggagctccgtgctgaggagcaggaagaaaagaggaggcgcgagcgccagggaggggcgaggactgggcaccgcggggaagtgacaggtctcgcagcaagttgcggttcggaagccggcgcgccgcgtctttccttcgccggccctgatttattgccccggtgctgccgctaagacgcgggcagtcgatgtacttccgggttcacacctttctctccccgctcggtgctgctgggtcggcgcccggtgtgggcactgcgttgccacagcggccgcccaggctcgccgctgcggttgctgccgggcggccaaagccggcttggagcgggagggcggggcggggcagggcgggggcgcaggccacgcgggggcgcagggcgcgagggtgcggcgcaggctggggtcccggcggcgggtcctcgcggccggtgccggctcgtctgggacgcacggggccgcgccgccagagggcgtgcgcacctccctttcgcgctccgcaagccgaactgctttgtaccgggcaggcgtcggggatcgtttttgctttggtatcggtgatgtaaattcatgaattaaaattaaggattttgaaaagaacggggaagaacgcacttggatttaggttgtttttgaaaaggaaaaaccaaagaggaaatgatacgtttgcaggagcattaactgactactgactggaacattggatgcgggtgctttgtgaa

SEQ ID NO: 126327 - DNA, 30 bp, Homo sapiens; identical to SEQ ID NO: 94527
  misc_feature 1..30: note = chr6:105389920-105389950
  misc_feature 1..30: note = Hyper
  source 1..30: mol_type = genomic DNA

SEQ ID NO: 126328 - DNA, 362 bp, Homo sapiens; identical to SEQ ID NO: 94528
  misc_feature 1..362: note = chr6:105400890-105401252
  misc_feature 1..362: note = Hyper
  source 1..362: mol_type = genomic DNA

SEQ ID NO: 126329 - DNA, 234 bp, Homo sapiens; identical to SEQ ID NO: 30722
  misc_feature 1..234: note = chr6:105401581-105401815
  misc_feature 1..234: note = Hyper
  source 1..234: mol_type = genomic DNA

SEQ ID NO: 126330 - DNA, 35 bp, Homo sapiens; identical to SEQ ID NO: 94530
  misc_feature 1..35: note = chr6:105404005-105404040
  misc_feature 1..35: note = Hyper
  source 1..35: mol_type = genomic DNA

SEQ ID NO: 126331 - DNA, 155 bp, Homo sapiens; identical to SEQ ID NO: 30723
  misc_feature 1..155: note = chr6:105404519-105404674
  misc_feature 1..155: note = Hyper
  source 1..155: mol_type = genomic DNA

SEQ ID NO: 126332 - DNA, 268 bp, Homo sapiens; identical to SEQ ID NO: 94532
  misc_feature 1..268: note = chr6:105404877-105405145
  misc_feature 1..268: note = Hyper
  source 1..268: mol_type = genomic DNA

SEQ ID NO: 126333 - DNA, 895 bp, Homo sapiens; identical to SEQ ID NO: 94533
  misc_feature 1..895: note = chr6:105405570-105406465
  misc_feature 1..895: note = Hyper
  source 1..895: mol_type = genomic DNA

SEQ ID NO: 126334 - DNA, 1557 bp, Homo sapiens
  misc_feature 1..1557: note = chr6:105584077-105585634
  misc_feature 1..1557: note = Hyper
  source 1..1557: mol_type = genomic DNA
tgctaagagtcttttcgcacttattcatgcttcaaagcaggcagtttctgggacttgtctggccaacaacccgttcccaaaggctcggggaaggaggttgcgggtgggtggcgcggacctcgggtccccagccatcggcgctctcccggggccctctgacctcgctccttaaaggaggagggtccgtggcaacggtcctcctcggccaggcgctctcgggacgcgggggtgaggagtgagcgccgtggcccaccctactctccgagcggggacggagtgggcgacaccgcgcgcccggctgcacgcaggctctgcgcggctcgaggcggccctacagggggcgaggaggaaccccggagactcggcggagagagcagagacggagctcaccaaggggcttgccgccgcagagcgcgggagccggcactcggtggggccgagggcccggggacgctggggctgcctgacctgagcggcggccgctgaccgttgagggtctctgtggccgcagcgcccagacccggggagaagggcggcctccaagggccgggagcccctcgagggcgcggccagcgaggagggacagagggcggcgcccccggctgcccgggcgcgtagaacaagcagctgccgccagggccgacaaagttgctccccgaggggctgagatccaactttcgcttcccgatttagccaggggagcgcgaggccgcacacaacccggcgcggggggaaagccggctgcagctgcgcctcccatccttacccggctggtccctggcggggagcctgggcagcgccgaccaaagttcggagcggcagcttcggggcgcgggacgcggggcacacgggctcagctgctcgacgggagcccgacgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccgcgccccccggcgggcggagcccggcgccgcggccaggatttcccacctcgctcccgcgactccgctgcgggtctgcacacccgaggactcggtttgaaacgcccgcttatttattttcttgtcgcctcgctacaagattctatccttgtttgggcatgagtggggggcggcagtctcgtgggaccggcggcattcgtcgttcctccttacggggataattcgagaagtgcggtccgggtagggagagaaatcaggagagaaaatgagaaagagaatcctcgtttcccctcaaagttggacgacccactcgtatatctcctttttgggagattcgcccataactcagcacaaacagggaatagcccggaaagcgcgcgagttcccgtccgattgtggcgggggaggctgaacgtttggtccacacgggtgcaggacgcgggggtcaggcctcctgctgcggaggaagagggggaagaggccgcgcgggagggacttctgacacgcgccactgtttttgt

SEQ ID NO: 126335 - DNA, 715 bp, Homo sapiens; identical to SEQ ID NO: 94539
  misc_feature 1..715: note = chr6:105627368-105628083
  misc_feature 1..715: note = Hyper
  source 1..715: mol_type = genomic DNA

SEQ ID NO: 126336 - DNA, 257 bp, Homo sapiens; identical to SEQ ID NO: 94540
  misc_feature 1..257: note = chr6:105750389-105750646
  misc_feature 1..257: note = Hypo
  source 1..257: mol_type = genomic DNA

SEQ ID NO: 126337 - DNA, 42 bp, Homo sapiens; identical to SEQ ID NO: 94543
  misc_feature 1..42: note = chr6:106114044-106114086
  misc_feature 1..42: note = Hypo
  source 1..42: mol_type = genomic DNA

SEQ ID NO: 126338 - DNA, 621 bp, Homo sapiens
  misc_feature 1..621: note = chr6:106429003-106429624
  misc_feature 1..621: note = Hyper
  source 1..621: mol_type = genomic DNA
aaactgctatgaattcggtgactgtgcaatgaaattgtcaattatcctctctgccttcctgcgttgaaagagtttcaagaagttgtggtgagtggatgtattcccagacggatgcgggcggtccccgggcagggaccccgaatccggggtcgcagggtggtagagccggaagattggattccatctccgcaaggattgagaaaaacggactcaccgactgaactattccatctccaagttgtttttattttccactttaagcataagaacgatgagaaccaggagccaggcggccccgcgtagcggtgggagcgcaggtacccgagagtaccctctgggggccggcccggcgcgctcgctcctcctcgcctttccgggaaccgtgcgcaggagctcacacggcacgcctgcggccaggggcaatcgggttctcggttcccggagtcccagttcccggtttccagtttccttatcgacgcgattgttccgtcggggtcttccaaggggatccgaatggtggccaagtcccgctggggaaatccgcaggggtgcggcctgcggggcctttgggggcgcacctacgccacgggctctgccattcctatccggaaaattcaagct

SEQ ID NO: 126339 - DNA, 177 bp, Homo sapiens
  misc_feature 1..177: note = chr6:106434102-106434279
  misc_feature 1..177: note = Hyper
  source 1..177: mol_type = genomic DNA
gacgagctctgaggccgaagatgcgttgcgtgactatgctgctgcctggacgcggggtctctagtccggaggcacggaaggacctgcctgcctgactctagtctgcaagtctcgggcacacgcgcggcttctgcccacccgcgtaaatgccctggggaaaggcgccctttcttttat

SEQ ID NO: 126340 - DNA, 1307 bp, Homo sapiens; identical to SEQ ID NO: 30734
  misc_feature 1..1307: note = chr6:106441813-106443120
  misc_feature 1..1307: note = Hyper
  source 1..1307: mol_type = genomic DNA

SEQ ID NO: 126341 - DNA, 30 bp, Homo sapiens; identical to SEQ ID NO: 94548
  misc_feature 1..30: note = chr6:106534045-106534075
  misc_feature 1..30: note = Hyper
  source 1..30: mol_type = genomic DNA

SEQ ID NO: 126342 - DNA, 329 bp, Homo sapiens; identical to SEQ ID NO: 94550
  misc_feature 1..329: note = chr6:106808855-106809184
  misc_feature 1..329: note = Hyper
  source 1..329: mol_type = genomic DNA

SEQ ID NO: 126343 - DNA, 97 bp, Homo sapiens; identical to SEQ ID NO: 30736
  misc_feature 1..97: note = chr6:106958240-106958337
  misc_feature 1..97: note = Hyper
  source 1..97: mol_type = genomic DNA

SEQ ID NO: 126344 - DNA, 87 bp, Homo sapiens; identical to SEQ ID NO: 94552
  misc_feature 1..87: note = chr6:106959519-106959606
  misc_feature 1..87: note = Hyper
  source 1..87: mol_type = genomic DNA

SEQ ID NO: 126345 - DNA, 107 bp, Homo sapiens; identical to SEQ ID NO: 94553
  misc_feature 1..107: note = chr6:106959939-106960046
  misc_feature 1..107: note = Hyper
  source 1..107: mol_type = genomic DNA

SEQ ID NO: 126346 - DNA, 715 bp, Homo sapiens; identical to SEQ ID NO: 94554
  misc_feature 1..715: note = chr6:106960308-106961023
  misc_feature 1..715: note = Hyper
  source 1..715: mol_type = genomic DNA

SEQ ID NO: 126347 - DNA, 44 bp, Homo sapiens; identical to SEQ ID NO: 40866
  misc_feature 1..44: note = chr6:107075561-107075605
  misc_feature 1..44: note = Hypo
  source 1..44: mol_type = genomic DNA

SEQ ID NO: 126348 - DNA, 332 bp, Homo sapiens; identical to SEQ ID NO: 94557
  misc_feature 1..332: note = chr6:107809976-107810308
  misc_feature 1..332: note = Hyper
  source 1..332: mol_type = genomic DNA

SEQ ID NO: 126349 - DNA, 43 bp, Homo sapiens; identical to SEQ ID NO: 94558
  misc_feature 1..43: note = chr6:107810622-107810665
  misc_feature 1..43: note = Hyper
  source 1..43: mol_type = genomic DNA

SEQ ID NO: 126350 - DNA, 126 bp, Homo sapiens; identical to SEQ ID NO: 94559
  misc_feature 1..126: note = chr6:107812382-107812508
  misc_feature 1..126: note = Hyper
  source 1..126: mol_type = genomic DNA

SEQ ID NO: 126351 - DNA, 165 bp, Homo sapiens; identical to SEQ ID NO: 94560
  misc_feature 1..165: note = chr6:107886594-107886759
  misc_feature 1..165: note = Hypo
  source 1..165: mol_type = genomic DNA

SEQ ID NO: 126352 - DNA, 75 bp, Homo sapiens
  misc_feature 1..75: note = chr6:107955933-107956008
  misc_feature 1..75: note = Hyper
  source 1..75: mol_type = genomic DNA
gccccccgggccccccgggcgcgggcggccagctcggcttcccaggcgtgctgcagggcccgcaggacggcgtca

SEQ ID NO: 126353 - DNA, 88 bp, Homo sapiens; identical to SEQ ID NO: 94561
  misc_feature 1..88: note = chr6:108274499-108274587
  misc_feature 1..88: note = Hypo
  source 1..88: mol_type = genomic DNA

SEQ ID NO: 126354 - DNA, 80 bp, Homo sapiens; identical to SEQ ID NO: 94562
  misc_feature 1..80: note = chr6:108280340-108280420
  misc_feature 1..80: note = Hypo
  source 1..80: mol_type = genomic DNA

SEQ ID NO: 126355 - DNA, 179 bp, Homo sapiens; identical to SEQ ID NO: 94563
  misc_feature 1..179: note = chr6:108323266-108323445
  misc_feature 1..179: note = Hypo
  source 1..179: mol_type = genomic DNA

SEQ ID NO: 126356 - DNA, 324 bp, Homo sapiens; identical to SEQ ID NO: 94564
  misc_feature 1..324: note = chr6:108434925-108435249
  misc_feature 1..324: note = Hyper
  source 1..324: mol_type = genomic DNA

SEQ ID NO: 126357 - DNA, 795 bp, Homo sapiens; identical to SEQ ID NO: 94565
  misc_feature 1..795: note = chr6:108436034-108436829
  misc_feature 1..795: note = Hyper
  source 1..795: mol_type = genomic DNA

SEQ ID NO: 126358 - DNA, 470 bp, Homo sapiens
  misc_feature 1..470: note = chr6:108438107-108438577
  misc_feature 1..470: note = Hyper
  source 1..470: mol_type = genomic DNA
cactcccgccctctacgacgtcctccctggcccgggcagcccaactggggcggggacgggggttactcgggtcggatccccttttcttccctatctatcctacctccactcccgcggccacgcgaaggcgtctcacccacccccttaggggcacgtgggcgaatgtctggtggccgggtgagtggaacccgccgcccagtccttgcagcgggctctggtctagtgggtgaggatccctggggaggtcccaactccggtgcagcgtccgcggggtgaagggcgcgagtgcattcaggccccaagggaaactcggggacatctgcacagacaagaatccccaaggaggcccaggtcccacggccaaagtcctcgacccccaccaggctgtctccctctagtcctccccactcctgacctgccattcgggacggagccagtccgcgggcacccaagggcgcaagctggtacaa

SEQ ID NO: 126359 - DNA, 139 bp, Homo sapiens
  misc_feature 1..139: note = chr6:108438779-108438918
  misc_feature 1..139: note = Hyper
  source 1..139: mol_type = genomic DNA
catgtgatgtgtgagcggtgtgtgatgtgcgtgtggtgcgaagaggggaggtgacaggccagagaggtttccccaaagggagaggcacggagggcttccggagtgagggtgcctgggggtgaggcgggagctgggcact

SEQ ID NO: 126360 - DNA, 1664 bp, Homo sapiens
  misc_feature 1..1664: note = chr6:108439495-108441159
  misc_feature 1..1664: note = Hyper
  source 1..1664: mol_type = genomic DNA
gtagcagaaaggaatcgaggcccccgtccataatcgcaggtgtcggcgtggaaaggagccacgcgtgcacactcatgggtctcaccgcgcgggcttccgcggcccggcaagccgctgcgcctgcctcgccggcggcccacggagcccgtccgcgcttgccctgcacacctgcgcccgcgcgaggacccagccgccgaggccgtgcgcccgccgggctgcgggggccgtgggcagggggcgcagggggcgcagggggcggccggcgcggcggctgaacccgggctgacgaggcccagccgcctgcggggcccggagcgggaggtaccggctaggggcgcgtttctttcgcatccacaccccgcccccacccctctctccagggattttttttttttttttttttgtatccaggcacagctgggggctccctcaccacccacccctggcctccccatacagaataaagtcagtctgtatttaatggttatggcggatgtgagggggatttggcagaggcagaagagaggcctttcgctctcaaatatcgtcccttacgtcgtgtgagtctaccaacccaccacgacctcatattcttgtgcgggtgtctgactcgaatgacaagcgagctgattttttcagtacatagctgggaaatgtagtgagtgataatagagatttctctttcattttttacgcttgacttggttattgttgcttttcttttcccgtgattccttctgaggattagctctgacttccccactattggcggtcaaagtggccccgactcgggatgacaattgacggggatcaagggattgcccattctgtgcctgtaagaaccgattcgtgccagagaaactcatcaagtggaggcggagaataaagaccgttcgggggtaaatgtattcattgagaagggttctcccaaattgcttctaagtttttttaatgaaaagtaacgattgcggcaatcagcggctttttggcggattacaaatctggagggagctgcggcgctgcattgaaaagtgcccccgccttcgcaccgggcagccggttcacaggagcagcgcgaggggcgggggtccgatagcgggacaaaggcggggagggggcgagcggaggagggcggctcggggcgcccgggcgcgcatcgggcaggagacgcggaggtgcccaccccagcgcaggcgtggcagggcgccccccaccgaggaaggcgtggggcagggtgcaggaaggggaccgagggaggtctaccgcagcaccaccagcactggggagattccgggcatctggagcgaggaaggtgtgctataggggttgagtccatcaccgtggaagtccggggaatgggaggtgcgactcggtcccccacctctaccccgggcacggtggtgtcttcttttaaagacgtctcacttcgcaattggaatcgaagcgtgggccggtgtcgggtcttcctggtgttacaggcaggaggagggaaaactgagtccttcctgggatggggcaggaccctcacacgcaagaccccactgagctggactggcgcgggggcggatcccttctcccaaatgcttctgaatggcgcgcgacctggtcccctctgccacacggaccctgcgcgcacgccctggccctggcggcctctggggaca

SEQ ID NO: 126361 - DNA, 21 bp, Homo sapiens
  misc_feature 1..21: note = chr6:108475755-108475776
  misc_feature 1..21: note = Hypo
  source 1..21: mol_type = genomic DNA
ttccatctggccaggcgcggt

SEQ ID NO: 126362 - DNA, 30 bp, Homo sapiens; identical to SEQ ID NO: 94572
  misc_feature 1..30: note = chr6:108478521-108478551
  misc_feature 1..30: note = Hyper
  source 1..30: mol_type = genomic DNA

SEQ ID NO: 126363 - DNA, 890 bp, Homo sapiens; identical to SEQ ID NO: 30747
  misc_feature 1..890: note = chr6:108478806-108479696
  misc_feature 1..890: note = Hyper
  source 1..890: mol_type = genomic DNA

SEQ ID NO: 126364 - DNA, 324 bp, Homo sapiens; identical to SEQ ID NO: 94574
  misc_feature 1..324: note = chr6:108484872-108485196
  misc_feature 1..324: note = Hyper
  source 1..324: mol_type = genomic DNA

SEQ ID NO: 126365 - DNA, 1969 bp, Homo sapiens
  misc_feature 1..1969: note = chr6:108485513-108487482
  misc_feature 1..1969: note = Hyper
  source 1..1969: mol_type = genomic DNA
aaagaaccccataatcgcgtccgcgttatgggggtggtggtggtaggtggctgaagcaagtggatttctggcgtgaaccagaacctgaggattccaaacggagcctggcatcttattgtgtttctcaaatcctgcccgaaattcctcccctctctgggcgccgagttcgagaaagcgctacgccgccggtcgggctagctccacaagcggctgtacaagttggctgtcaaaaaacgctgatttctcctcctgtcacctaataaacccctacgcgcttatggcctcgtcccacaatcccccaatctcgtcccaattcgaaaaaccgaggaggagggaataaactgagagataaagatccccccatcttgctctttccccgggaccccagccttggtcgcggcgccccactaaggaggacacaggctctggtgtgtgtggtgtgcgagaccccgagctcgaggccgagccaaggctgggcagaaagttgcaatcacgtgctgtcggagcccactggagcgcacagcccgctccccctgggacgcccaggcggaggacctgctgcgccctcccagggctcgggggactccagcattcacttgcacgcacaggcgaactctgattgaaagcccgggatgacaccgagtctggagaaagagggaccggggggtgggctggcggaattgcagagcgccggccacagctcccctccccgcgaacgtcgagcggagggcgggaggtgtaacctctgacctctggccgggtccacgccctgaggagggactggcaagctcttgttcgacaagttcaagctgccgagagagcttaaatagaattaatctcttagagatcggggatcatcgctccctcggcatgcgctctcccagcgccgcgcacagagcaaggcgcgagagagctcaggaatcgcgggaaggcaagcggaatggggagggggtaggggatgagggcctctcttcactattcctccgcccggagagcgggagcccgcaacgcccgccgaggacgagcggcgggagggaacgctctgccctccagccgccccggtgcagataatggaggcgacaagagattcgctcagcgtcggatgggccagctctgcttggggaagctggcggcatcctcccctcggctggtgcccaaacccactgcgcgaaggccgaaggaacgcggaacctccagaagaccccatcctcagccctgactttccgtagatatgtgcaaaatgagtaaattactcacctcgggccagatccaagttttacccaacagaaggggcaccggaccaagaatgaaccaactcacatggccatgtccggcgcgcacaatcacacgccagcacacagccacccaatttcttccgcgaatctatctggcactctggagagagggggaaaagcgttttgagaaagccccgtcacccctccccttccttcttgccgtgaaatatacgaattcatttttattacgagccgcaccgtcctcaccatcacgcacgcacagagccacactcccatattcacactttctaactcgtaagctccgacagcgcctgcattttctttgggagccgcttggaggttcattaatatcattagcatttaaccccctccctcttcccatcccctccccgcacatggctgacgtcagaccccgccaggagttgggggaaaagctaagtgggccagggacgccctattcccctccccgcggctgcctgtcagagcgcttctggagatattacaggggacccagcccgcagcgacaggcacaaagtcacggggtaatgaacttcggggacccttcgccgctgcgtgcgcggctctccccggaaacccggacctggccgcctcttccctcggaagatttcccagcaatctagttttcccactctgcgcttgggttccggcagcgcggagcccgtctgcctctgagactgcggtagtgttttcct

SEQ ID NO: 126366 - DNA, 1222 bp, Homo sapiens
  misc_feature 1..1222: note = chr6:108487779-108489001
  misc_feature 1..1222: note = Hyper
  source 1..1222: mol_type = genomic DNA
atttccactgttggacgaattctgagcgcccagggagcagcgcagcgcgcgactgacacccacctgtcccgcccaggagccttgcaggctggagggcagctggagagcggcggcgcccggcggcgaggcgggcgctgccggccgggactcgggcagcgcccaccaaccgctccgccccgggacagccagcatgagcaagccagccggatcaacaagtgggtacctctcgggccgccgtggggcctaggcgcgcagcctggggcgagcgagcggggaggctgggggaggtcctgcctggagcgctgcgaatctgagcccctgagagggattccagcgggcgtgtgcgttcggcccagacctgtagaccgtgagttggagcatttcgtggagaggggagagccgtttcgttgcctctggattgcttgatcccccctgtctggtgcggtgagaaggttacgacccgcgcagcccaccagtcggatgagttgtctccatttagccgccaggtgctggatgggggggccatgggggcgggaactgggccgcagctccaggcggtagcacaataacacactcgctcaaaactccgagctccagcgcgcaaaagcaactctgtgcaaagcggattttgaatggaatgctttgcaccccgtttctagctatttcaaataatcctgcaaactgggaagcagaaacaatttaaaagtcacattttccttaatcctaaatccgcgtaggtcataactggggaatttaaagtatggcgaaccactctagcaaagagaggaccaaatccctaatcccaaggacttttcgagccggagcccagcagaggcaggagtgcgcggcctgctccctccgtgcgcttctctccttcctcgaacttccttagctgccggctctccgaacgccaggccgcagctgacctctcaccaccccgagactcacgagcgcagggctaagtgtgtgtgcgagggcatttgcttgcaccctgcctgcggaacccaagaatgtgcaggcccgagccagcgttgagcaggcgcggtcacggtgctcagatctcccgggggcatttcagttcccgccatccagtggcccacggctgcgggctccagggtctgaggctggggactaccgttgccgccgcagtccccatatcccgaagttgccttgctgcttgtgttgttttcgcagatagcatttttggcgctctgtgcgttcc

SEQ ID NO: 126367 - DNA, 2116 bp, Homo sapiens
  misc_feature 1..2116: note = chr6:108489330-108491446
  misc_feature 1..2116: note = Hyper
  source 1..2116: mol_type = genomic DNA
gcctaccctggccctcgctgttggaatctccaggaggtaaagcgacctcgatttttgttgcccgcattcccgggcgtgagtgtccttcccaggaggctcaggaggccgtttctgttgcattctgagcctccgttgcaaaaactgaagcccgtgggtctcggcaggcctcctagctcgctcgccccgggacaggccctcgcctacacccctggaagtaaggagccccgggctctttcgtccttttcggggtgtggagcccctggggcccttgaaaggtgaggcctcagaggcgagggaggggtgagcggggagctctgcccgcctgcggctgcgcccccgctgtggactaggaggcaggccaaccctccggactttgggggaaaaaccacagcgggctccttgcggaaactttggccgttctaacttgccaagagcctgagtgaggccttggaagcctccagccccggctcaggtcgggacgcggctgctgagctttctcaggcccgcaggacagcggcccccgccggtggcgccgctgcatttaggccctttccagaccggtggcggcagccaacccgagacttgcgtccctcgggcccggggcagctaggaggtcggcgcgcagcgggccgggtcaggactgggtcgagcagacagagctgcagcccccgccttgcccggcttctcgcggctggagagcagagcgatgtcacccggagccccgcctgggtggtaacgagaccctggccagtcacccctgcagcccagactaacttctttcaacagcctctgatggtaattacagtaatcgaagctgccatatatctttaggcaattatgacacacaaaaagccccgaggggaccccctggcgagggaagttaagaacggttttccagcttcaggaaactccggctcgcctcacgtcggagctcgctcggcttgctaaatgagaggagctttgcaacggggtcaaccagcttgtctcgtgaccccaagtcaccttaacgtggctgggtggcggagtctgaggcacaggcccgctatgccccggaattttcgcgtccctccctcctgggccccgccccagcccggttgcctgtttctaatctgccccgggagccgcggctcagaggtctgctcagaggcaggactcgcactggtggtggcctagagggcaacagtccggaagctcgggcgggggaatccgaggaggggcccccaccctgcactggtcttccctccaccctcatcgggttctccagagatgttgtcatgggcctcctgtccggatgggaagtggggaaaaagagaccccaccactgctcctcccactcactcatcttggcatcttcaacagtgccacagggaagaggacagctggggtgacagtactgctgggccccaaacgtggaccctggagcggtcagagggcgcgtgttaagcagaggatggttgtaagatatggaaaccaagtttaccgcttccagagtgagtgcagtgcagcggagctccagacccggttcctgagcgaccaggaactcccttgggcgcagtgacaggcccgaaggagtggaggacaagacccgctgtgcccttgcctggccctctccagcccctccctcccacagcacaatctcccctcccgccctgtgggaggggggcgccgagccggtggccgccgcgccgcgcgcctcccctgcccgcctttgtcgccgtccgaattcccatgctactctttttgacgggtcactggtggctctataggcaggtgctgccgcggggttgtaattacccggccgagcctggtcgttaccgaacaccccctcacccccaagcacggtcccccgcgctctccttcccccaccccctccacctgagacgagtctgggacccacggtgcaagctcgcccggacgcctcgggttccaggagcaagtttacacctgcggtgcctcgaggccctccccgcgccacgccctcacctcccctactcccctcgcccagacgttccactgccgccccttcccacctcaatcccatcgtagtccccaacccaagcgctttcggcagcagctgtcgaatttcagggaggcctgaggccgctggggcccaaac

SEQ ID NO: 126368 - DNA, 346 bp, Homo sapiens; identical to SEQ ID NO: 94585
  misc_feature 1..346: note = chr6:108492203-108492549
  misc_feature 1..346: note = Hyper
  source 1..346: mol_type = genomic DNA

SEQ ID NO: 126369 - DNA, 1270 bp, Homo sapiens
  misc_feature 1..1270: note = chr6:108495639-108496909
  misc_feature 1..1270: note = Hyper
  source 1..1270: mol_type = genomic DNA
tctctggggccaagtcgctgtcttcggtcctgaagtctcgtccctgttccaccactccgcgactggcggaagttcccctagcgagagccccgcaggcctgcggggtctgccaaacccggctctctaagcttcacctgcttggagaaggacgtttcccccttgtccgctttcttggggtccgggactggccctcttgaagtagcctgggacgtcccagccccttctcgatctggccctgctcatgcccaaggccctcgcgttttgcaggcccaggctcggggctccagggcctgcggccgggcaaggtcgcgcctccacaccgtttccccgcccgggtgccggctccgggtctccagcctaaaggccctggggaccgctgacctcctgctctctgttccagggaggctgtccggtggacaagacgcacagaaaccagtgcagggcgtgtcggctgaagaagtgtttggaagtcaacatgaacaaagacggtaatcagtgcatccctttattccaatgttgattgagtagtaagtaaattatatgtacagaaaatacatggcactcctatgcatgtaaatcaaccccggagcgcttctttccagatgctgggaattggcctcgggctttcagtcgtatccttcccgtctttcagcaggagccgctggcgacccctagaattccccagggcaagacccatgcccacatcaggaacttgcgccccacagtcatctccacacaggcagcgcttggggggaccccactctccaggggaccggcgcgcattttctgcctccggtcctaatccctctttgcagcccttcgtggccacccttaagcctgctagcctgccccaggatcttaaaatctggatagtctcacggggaggagatcatacaggctggaagttcgcggtgtgttgaaaaagggagggcagagacgcgaaaacgcggaatttccagcccgtgtgcaaattctccaagatgccaaaatcagtacggccattgggccgatgtgagtccagggccttctctctgttctacagaaaagagggaaagggggctggagaggcagggtaacgcccgtgggtgcctcggacacccagctctcccaaggctcttaagcgcgcaacagcaagaaccaggacgtcagagtgcttcctgggcctggagcacggtccgagctgcgtcccccgctgcagcctgtcgagggcgccccaggcccaggcagggggcgagggtaatgggctggaggacaccgtggggcctgggaa

SEQ ID NO: 126370 - DNA, 837 bp, Homo sapiens
  misc_feature 1..837: note = chr6:108497125-108497962
  misc_feature 1..837: note = Hyper
  source 1..837: mol_type = genomic DNA
tttctccagcatactcggagacgggttctccctcgttccattccctagcaatcccggggctcgggtcctttcctcctgcggccctcggaggccaaaagctatttctgtgggggcggggcctgcgggtagggaggcttgttcttggacggagctggaaaagtctgcgcagaaacgaggtgtctggcgtgcgcgacgctccctctcttttggatgggggcgaggatacctggctactccagcccagagggtctctggtttccctgcgaacccccttccctggtggggaggagccctggaccgaaggagaacacacctggtcttacttgaggctctgccattatcgtggcactttgagcacgggcccctcttctaagcctcagcttccgaatctattcagtgtagtggttagacgatctcagaatcccttcctccctcagattccctctcccttcttcttttcacctcttgggcgattttgcccgcccagacttgacattggggcggggctggggggagagccgcagcggctgtgtctcgacgtctctaatcgccggcatgcgtttctctgtttgcctctgcagccgtgcagcacgagcgggggcctcggacgtccaccatccgcaagcaagtggccctctacttccgtggacacaaggaggagaacggggccgccgcgcactttccctcggcggcgctccctgcgccggccttcttcaccgcggtcacgcagctggagccgcacggcctggagctggccgcggtgtccaccactccagagcggcagaccctcgtgagcctggctcagcccacgcccaaggtcagcggccttgctgggcc

SEQ ID NO: 126371 - DNA, 131 bp, Homo sapiens; identical to SEQ ID NO: 94595
  misc_feature 1..131: note = chr6:109038572-109038703
  misc_feature 1..131: note = Hypo
  source 1..131: mol_type = genomic DNA

SEQ ID NO: 126372 - DNA, 24 bp, Homo sapiens
  misc_feature 1..24: note = chr6:109057736-109057760
  misc_feature 1..24: note = Hypo
  source 1..24: mol_type = genomic DNA
tgttaggaatattctcggcccggt

SEQ ID NO: 126373 - DNA, 82 bp, Homo sapiens; identical to SEQ ID NO: 14879
  misc_feature 1..82: note = chr6:109059835-109059917
  misc_feature 1..82: note = Hypo
  source 1..82: mol_type = genomic DNA

SEQ ID NO: 126374 - DNA, 39 bp, Homo sapiens; identical to SEQ ID NO: 94598
  misc_feature 1..39: note = chr6:109578459-109578498
  misc_feature 1..39: note = Hypo
  source 1..39: mol_type = genomic DNA

SEQ ID NO: 126375 - DNA, 139 bp, Homo sapiens; identical to SEQ ID NO: 94599
  misc_feature 1..139: note = chr6:110299095-110299234
  misc_feature 1..139: note = Hyper
  source 1..139: mol_type = genomic DNA

SEQ ID NO: 126376 - DNA, 193 bp, Homo sapiens; identical to SEQ ID NO: 94600
  misc_feature 1..193: note = chr6:110299501-110299694
  misc_feature 1..193: note = Hyper
  source 1..193: mol_type = genomic DNA

SEQ ID NO: 126377 - DNA, 30 bp, Homo sapiens; identical to SEQ ID NO: 30765
  misc_feature 1..30: note = chr6:110299948-110299978
  misc_feature 1..30: note = Hyper
  source 1..30: mol_type = genomic DNA

SEQ ID NO: 126378 - DNA, 869 bp, Homo sapiens
  misc_feature 1..869: note = chr6:110678874-110679743
  misc_feature 1..869: note = Hyper
  source 1..869: mol_type = genomic DNA
cttcttcacgggatgcgcggagcctagaagggcgcccggccacggcgacccccaagtactggctgaatagtgaatgaactccgcttggccgcacttcagtctatctgggcactgaaagatgcgacccgtggagccgcctaagagagcacagggggaagagaagaagcggaagcctccggaggtcccatcgaggcggcctgcgggacctgagcgccgggctccgtagcgcggtcgggagggggcttctggtcccaggcccaagaccgaccgctttgcaactgaccttccggcgggggcgcccgcgcggggcacagcagccaggctccggcgtcccgctcccgccgccccccggcggcgcccggcgaccgctgcgcacgtaggtcacctgcctcctgctggcgccgcgcggctggcccggcgcgggcggcaggtgcggcccaggtggccgccaggccgggcccggcggggcgctgcgggtgggggacccgggcccggcgcgccgcagctctgcgcagagccgcaggccgaacaacagcacagccccgagtagacaccggcgcaggacgccgcagcccctcccgggcggcctctcccgggccatggcgctacactcggggtcccgcgggccgcgcctggccggcagcagggatgtagccccacaggccggagcggccaactgtgggaactcccccgcgggccggggtgcgggctcggacccgcctccctccctcccgaccgaggaagccccggcgtaaccttatcctgccctgccgagcgcgccccgccgctggaacggtggtgggccgaacgcggtcacagggggccctctccgcccctccggaggtgccagggcccggctgtacagggtc

SEQ ID NO: 126379 - DNA, 454 bp, Homo sapiens
  misc_feature 1..454: note = chr6:110797490-110797944
  misc_feature 1..454: note = Hyper
  source 1..454: mol_type = genomic DNA
tccgagcgagcccagcgcctctgctcaccatgccaggtcccgctgccagaggcctagaggagaagcccagctaggggccggcgtctggacgcccgtgtcccgactgcgcggggtgaggaggaagtggagatgttttcggatcgcgagcgccgcgcgagaaccccgccgcaacggaaagaaacagacccctcggcgccgcctcccgcgtggcgccgcggggcccctcccccatacctgccgaagtgccccacgtggtcataaatcccctcgaagtggcgggaccccatggtgcggccgtgcactgggcgccgagttagccgagctccggggactgcgggtagcgcgccccgccccgaacctccccgcccggcctcctgctctccccgcgcgtcccagtgctcgggaccagcgcgaggctgtattctgttcctccctccgtcgcttggcccctcgg

SEQ ID NO: 126380 - DNA, 52 bp, Homo sapiens; identical to SEQ ID NO: 94608
  misc_feature 1..52: note = chr6:111409316-111409368
  misc_feature 1..52: note = Hyper
  source 1..52: mol_type = genomic DNA

SEQ ID NO: 126381 - DNA, 217 bp, Homo sapiens; identical to SEQ ID NO: 30769
  misc_feature 1..217: note = chr6:111409641-111409858
  misc_feature 1..217: note = Hyper
  source 1..217: mol_type = genomic DNA

SEQ ID NO: 126382 - DNA, 16 bp, Homo sapiens
  misc_feature 1..16: note = chr6:111581391-111581407
  misc_feature 1..16: note = Hypo
  source 1..16: mol_type = genomic DNA
gcgtgagccacggcgc

SEQ ID NO: 126383 - DNA, 30 bp, Homo sapiens; identical to SEQ ID NO: 94611
  misc_feature 1..30: note = chr6:111874444-111874474
  misc_feature 1..30: note = Hypo
  source 1..30: mol_type = genomic DNA

SEQ ID NO: 126384 - DNA, 53 bp, Homo sapiens; identical to SEQ ID NO: 94613
  misc_feature 1..53: note = chr6:114177562-114177615
  misc_feature 1..53: note = Hyper
  source 1..53: mol_type = genomic DNA

SEQ ID NO: 126385 - DNA, 872 bp, Homo sapiens; identical to SEQ ID NO: 94614
  misc_feature 1..872: note = chr6:114663003-114663875
  misc_feature 1..872: note = Hyper
  source 1..872: mol_type = genomic DNA

SEQ ID NO: 126386 - DNA, 268 bp, Homo sapiens; identical to SEQ ID NO: 94615
  misc_feature 1..268: note = chr6:114664337-114664605
  misc_feature 1..268: note = Hyper
  source 1..268: mol_type = genomic DNA

SEQ ID NO: 126387 - DNA, 137 bp, Homo sapiens; identical to SEQ ID NO: 40872
  misc_feature 1..137: note = chr6:116574057-116574194
  misc_feature 1..137: note = Hypo
  source 1..137: mol_type = genomic DNA

SEQ ID NO: 126388 - DNA, 61 bp, Homo sapiens; identical to SEQ ID NO: 94617
  misc_feature 1..61: note = chr6:116783506-116783567
  misc_feature 1..61: note = Hyper
  source 1..61: mol_type = genomic DNA

SEQ ID NO: 126389 - DNA, 158 bp, Homo sapiens; identical to SEQ ID NO: 94618
  misc_feature 1..158: note = chr6:116937904-116938062
  misc_feature 1..158: note = Hyper
  source 1..158: mol_type = genomic DNA

SEQ ID NO: 126390 - DNA, 30 bp, Homo sapiens; identical to SEQ ID NO: 94619
  misc_feature 1..30: note = chr6:117001154-117001184
  misc_feature 1..30: note = Hypo
  source 1..30: mol_type = genomic DNA

SEQ ID NO: 126391 - DNA, 668 bp, Homo sapiens
  misc_feature 1..668: note = chr6:117086196-117086864
  misc_feature 1..668: note = Hyper
  source 1..668: mol_type = genomic DNA
tgttggcactgcggccgctttcgctcctaggtggccgcggtcggaaggtgggtcaccccgcacccttgcggccggggaccgactctccttcgcgcggcggtcgccacacttacgggatccgaggcgggatctcctccatcgatttgaaacgccctgtccacagcaggattttcttgtcgaactgcgaaggcctgcgctgcgtggggactcggtgaatctcccctgcagcgaaagcaacccagatggacgcgggaactgacgcaccggcacagaggatcagcgcgccctcaagccgactcccgggccggcccctcgctgccctcccgcaacctcctccctcccaggacctccccgtcggagccctggctcaccgtgaccttggggcccagaattgctgggggccccgccgctggagtagcaggggagaccccggggcggaagagccggtgcgggccgtcgcgtggcctcgagaggcgccccggggccgcagcggactgttagcccgcggccaaggcgcagtaggctcccgaccgccctgagcatgctgcccgcttgtcccgcgccgcacccgcacctccggacccagccacaggcgttgtccccgcagctctcctcgtcccgccccggcctgccgcgcgctggagagcctgggacgtgcagctggaacc

SEQ ID NO: 126392 - DNA, 21 bp, Homo sapiens
  misc_feature 1..21: note = chr6:117089618-117089639
  misc_feature 1..21: note = Hypo
  source 1..21: mol_type = genomic DNA
ccaccacgcctagccagcaca

SEQ ID NO: 126393 - DNA, 74 bp, Homo sapiens; identical to SEQ ID NO: 94623
  misc_feature 1..74: note = chr6:117197631-117197705
  misc_feature 1..74: note = Hyper
  source 1..74: mol_type = genomic DNA

SEQ ID NO: 126394 - DNA, 169 bp, Homo sapiens
  misc_feature 1..169: note = chr6:117198137-117198306
  misc_feature 1..169: note = Hyper
  source 1..169: mol_type = genomic DNA
tgtgggcgcccagggcgtgacaggcgcaggtgagaaagtgagtttcgcgggagcatctgccgggaccgcagacaggtggagaaacgcagtcccaccgcggcccaccgcggctcccgggcggcctgggctgtacctgtgcgcggcgtcctttctgcgctgagccagggca

SEQ ID NO: 126395 - DNA, 30 bp, Homo sapiens; identical to SEQ ID NO: 30778
  misc_feature 1..30: note = chr6:117198544-117198574
  misc_feature 1..30: note = Hyper
  source 1..30: mol_type = genomic DNA

SEQ ID NO: 126396 - DNA, 849 bp, Homo sapiens
  misc_feature 1..849: note = chr6:117585846-117586695
  misc_feature 1..849: note = Hyper
  source 1..849: mol_type = genomic DNA
aactttaaaggaccccggccaaggagaccccagcatgaaaagccagacatccgaggccgggtaaagcctcctggactcctcgaaagcagctcacaccgggagcagccggaagcgggcgcgatctatgcgaagctaacgggttccggtggagaacatcaaagagaaaggagcaggatcgaactttagaggggcagaagggcacggcccaagagagcagaattggggtgtgggacaggcggcgggaggaccaggttagagggagcgaaaggaagtggattagaggacagcggttacaggtttcagccactgccatttccccgcagaggtagctcttctgcgccctggaggggtacccggactcccacatcctgtctgccacgacccggactccctaggggattccaagggacagcaccgtcctccccatacatcatcaggaaccgaaagcagagaatttgccccacctcggcacttctggaagcacccactcaactacagtatgagacaagggctttcctaagagacctttctccaactttctttctctgcgtgtatgagcccggatcccttcgtccccgcctccttctctctctctctttctctctctctcctattttgtcctgggagattcctactcgcggtgcgaagcctcggatccgctgggaaccgcatagtctccggcacccttggccgcatgcttgtcagaggtgggccccgggaaacacactcgctgcccctccaacaagcgtccctcgctccccattggccccccggtccccgccccccaccgccccctcccgctccgcagcccccgagtggcgtcagcacgcccgccgggcatgggcttta

SEQ ID NO: 126397 - DNA, 167 bp, Homo sapiens; identical to SEQ ID NO: 94627
  misc_feature 1..167: note = chr6:117587123-117587290
  misc_feature 1..167: note = Hyper
  source 1..167: mol_type = genomic DNA

SEQ ID NO: 126398 - DNA, 101 bp, Homo sapiens; identical to SEQ ID NO: 94628
  misc_feature 1..101: note = chr6:117587547-117587648
  misc_feature 1..101: note = Hyper
  source 1..101: mol_type = genomic DNA

SEQ ID NO: 126399 - DNA, 1071 bp, Homo sapiens
  misc_feature 1..1071: note = chr6:117591136-117592207
  misc_feature 1..1071: note = Hyper
  source 1..1071: mol_type = genomic DNA
gacttcaaaatatgtcgatggactttcagtctgtcagagacgttaggtggtggggggcacattttctggagcaagaaggctgaaacgcgagagggggtagtgagatcactaggcggccgaccaagagtgggaagaggtatcgttagcttggggagaggttaaggctaggaaagggaggccgtgctgcgctgagtcgcgggaagctccttgagcttcaaggacttgagtcggggagggagtctctccgctcttgctactctacccgccacttggtttccgcactgaggactcggctgcgaaatgggaggaagcaggcctccttttcgtgggttcccagaagcccccattttgcagttcccccacctcgctttcacaggttgcagcccccttagaaaaacgccgctgcagaggcgggggctgcccatcagccccggccatggctagccagccctgtgcccgcccggcgccttcgtctctcgggcgggacgtgcaggtcggcgctgagtccagccgcagtgacacgcacctcttttcctttcctccactccgcctccccggccggcctacagactgctccttcccgatgagccagcgcagcttccccgcctccttctggaatagcgcgtaccaggcgccagtgcccccgccgctgggcagccctctggccaccgcgcactcggagctgcccttcgccgccgccgacccctactcgcccgccgcgctgcatggccacctgcaccagggcgccacggagccctggcaccacgcgcacccgcaccacgcgcacccgcatcacccctacgccctgggcggcgccctcggcgcccaggccgccccctacccgcgccccgccgccgtgcacgaagtctacgcgccgcacttcgacccgcgctatgggccgctgctgatgccagccgcctcggggcgcccggcccgcctcgcaaccgccccggcgcccgcgcccggcagtcctccctgcgagctctccggcaaaggcgagccggcgggcgccgcgtgggccgggcccgggggacccttcgcgagcccctcgggggacgtggcccagggtct

SEQ ID NO: 126400 - DNA, 20 bp, Homo sapiens
  misc_feature 1..20: note = chr6:117913241-117913261
  misc_feature 1..20: note = Hypo
  source 1..20: mol_type = genomic DNA
gcacaaggctgggcacggtg

SEQ ID NO: 126401 - DNA, 30 bp, Homo sapiens; identical to SEQ ID NO: 40873
  misc_feature 1..30: note = chr6:118113403-118113433
  misc_feature 1..30: note = Hypo
  source 1..30: mol_type = genomic DNA

SEQ ID NO: 126402 - DNA, 1855 bp, Homo sapiens
  misc_feature 1..1855: note = chr6:118227995-118229850
  misc_feature 1..1855: note = Hyper
  source 1..1855: mol_type = genomic DNA
ccaggccaattatggcgaatgtagtaggagcaacatctaggattctccgtttgggtttctaatccggggccggcacctgtctcggcgtcctgccgctgtcccaggccggtggtgctggattccgcggcgcttgggcagaaacgaggaatccccgccaactccacagggaggatctattcccagcccccttatccccctaaaaaacacccaaaccaaaacaatcaccacaacctagaccgtgggcctctgcggacggggcagtagagggtcgggggcaacaaggcacctcggcagcgccctctggcgagaggagagcgcgcaggtcccccgcccgcgccccgctctgccgccgccgccgccgccgccgccgccgccgccggcgcccccgcccggctctccgggttcaccctcggtctctcactccgtgagacacagacggtagctttccgaccgagcggggcacaggctgaggcggcgccagcacaactgccgccgcgcgccccgaggagacccgggcacgaggaaacaaggagaaatcaggactccttccccggaaccgaccggcagctccgcgcccccgcgcgacacccttcgcagccacttcgcggggcgggccaggacttggggacgcggctcgggaagagccggggcgggcggcggcggcggcggcacgggcgcgagggtgcgcgcactgggactggagaggagtgagtggcgggctgggcggcggcggccgtagccgcgggtgcctccccgcctcaccgcttcgcaggcagcaccgcctcccgggccgcggccgcccggccgggtcctctgcgcgttcccgggcccggaaccggcacacgatgcacccggctgcgttctgatcgccgccgcgcctcagcctctgccgcgatgatcccccctgagcagccgcagcagcagctgcagccgccgtcgccagccccgccgaaccatgtggtgaccaccatcgagaacctgccggccgagggcagcggcggcggcgggagcctgtccgcctcctcccgggctggcgtgcgccagaggatccgcaaagtgctgaacaggtgagcggcggcgccgggcgagggcgcggggggcgggggctgcgggcgcccggctccgggtcccctccgtccctggggcggcccacgggtcctttgggacggggttgcggccggaggagactgaggagatcgggcgacgacgcgctccgcgggcgcagagaggccgcggcagctttgtcccggcgcagggagccctggagtggtggagctgcagctggtccgaggcgggagttcggggagaggcggggtttttcgtacctagccaccctgtatgtgtgtccgcactcacaccctccatacgcgtgccgcctcacttccctttccctctcgcaccccggctttgcgatcgggggtcggggggacgcggggacccggccagggctgaggagggaggcgcggggctgcagagatggcgtggaagtcctgggcctcgtgctgtcctccgccccgccccgcccgggggcttcgaccccttgccgggggaatggggtcgcagcgacagcctagcaggcggagggaacccacttctccagcctgacgctccagtcgcctctcggactcttcctggctgggagcagcgaagagagggctagaggcctggaacagacccagcaaagtgcaaaacattgcgggcagggtgtgagccggcggcgcccagttattccgaagcgcccatgccggagggggcgggtgccgatcgccggcgcctccagtgctggaatctgcgtagtggattcaggacgttgacgttttaggatgaggacctgggttgacgtgaaaatgggggt

SEQ ID NO: 126403 - DNA, 521 bp, Homo sapiens
  misc_feature 1..521: note = chr6:118241005-118241526
  misc_feature 1..521: note = Hyper
  source 1..521: mol_type = genomic DNA
tcagcccaggagctccgcggtacctgtggttcctgaaagagagtttgacaggcttcaggaaagggttagtgcctcttgaactggggagattacaaaacgagcgtgggcctaaaaggctccacagaggcaggcagcgggatggatagagcggctcagagggaagggacagagccgctttaatgtgctaatgaggggaagcccagatgccagcgggctcagtggagctctttgtgacgccgggttcccggggctggctggagtctctgtacctatctggatcctgctgcaggccggggaaacactgcgctcttagagaggggccctgtcctccacagatagccccgcagaccctcggaacgcgggtggacggggagggcgtgcgcgagcctcggggcttgggtggtggctggaaaagggagaaccaggaggcgggggaggggcgctcggactacagaggaccggacgggggcgagtgttccgcggggtgtgtggagtaagagctgggacggacctttgtagct

SEQ ID NO: 126404 - DNA, 143 bp, Homo sapiens; identical to SEQ ID NO: 94641
  misc_feature 1..143: note = chr6:118971559-118971702
  misc_feature 1..143: note = Hyper
  source 1..143: mol_type = genomic DNA

SEQ ID NO: 126405 - DNA, 152 bp, Homo sapiens; identical to SEQ ID NO: 94642
  misc_feature 1..152: note = chr6:119030526-119030678
  misc_feature 1..152: note = Hyper
  source 1..152: mol_type = genomic DNA

SEQ ID NO: 126406 - DNA, 30 bp, Homo sapiens; identical to SEQ ID NO: 40874
  misc_feature 1..30: note = chr6:119240714-119240744
  misc_feature 1..30: note = Hypo
  source 1..30: mol_type = genomic DNA

SEQ ID NO: 126407 - DNA, 30 bp, Homo sapiens; identical to SEQ ID NO: 40875
  misc_feature 1..30: note = chr6:119254223-119254253
  misc_feature 1..30: note = Hypo
  source 1..30: mol_type = genomic DNA

SEQ ID NO: 126408 - DNA, 149 bp, Homo sapiens; identical to SEQ ID NO: 94645
  misc_feature 1..149: note = chr6:119254660-119254809
  misc_feature 1..149: note = Hypo
  source 1..149: mol_type = genomic DNA

SEQ ID NO: 126409 - DNA, 543 bp, Homo sapiens; identical to SEQ ID NO: 94646
  misc_feature 1..543: note = chr6:119399076-119399619
  misc_feature 1..543: note = Hyper
  source 1..543: mol_type = genomic DNA

SEQ ID NO: 126410 - DNA, 36 bp, Homo sapiens; identical to SEQ ID NO: 94647
  misc_feature 1..36: note = chr6:119510906-119510942
  misc_feature 1..36: note = Hypo
  source 1..36: mol_type = genomic DNA

SEQ ID NO: 126411 - DNA, 157 bp, Homo sapiens; identical to SEQ ID NO: 94648
  misc_feature 1..157: note = chr6:119527110-119527267
  misc_feature 1..157: note = Hypo
  source 1..157: mol_type = genomic DNA

SEQ ID NO: 126412 - DNA, 45 bp, Homo sapiens; identical to SEQ ID NO: 94649
  misc_feature 1..45: note = chr6:119538695-119538740
  misc_feature 1..45: note = Hypo
  source 1..45: mol_type = genomic DNA

SEQ ID NO: 126413 - DNA, 20 bp, Homo sapiens
  misc_feature 1..20: note = chr6:119560062-119560082
  misc_feature 1..20: note = Hypo
  source 1..20: mol_type = genomic DNA
ttattatttttgagacggag

SEQ ID NO: 126414 - DNA, 32 bp, Homo sapiens; identical to SEQ ID NO: 94651
  misc_feature 1..32: note = chr6:119584473-119584505
  misc_feature 1..32: note = Hypo
  source 1..32: mol_type = genomic DNA

SEQ ID NO: 126415 - DNA, 147 bp, Homo sapiens; identical to SEQ ID NO: 94652
  misc_feature 1..147: note = chr6:119590025-119590172
  misc_feature 1..147: note = Hypo
  source 1..147: mol_type = genomic DNA

SEQ ID NO: 126416 - DNA, 151 bp, Homo sapiens; identical to SEQ ID NO: 94653
  misc_feature 1..151: note = chr6:119604968-119605119
  misc_feature 1..151: note = Hypo
  source 1..151: mol_type = genomic DNA

SEQ ID NO: 126417 - DNA, 42 bp, Homo sapiens; identical to SEQ ID NO: 40878
  misc_feature 1..42: note = chr6:119689647-119689689
  misc_feature 1..42: note = Hypo
  source 1..42: mol_type = genomic DNA

SEQ ID NO: 126418 - DNA, 30 bp, Homo sapiens; identical to SEQ ID NO: 94655
  misc_feature 1..30: note = chr6:119714970-119715000
  misc_feature 1..30: note = Hypo
  source 1..30: mol_type = genomic DNA

SEQ ID NO: 126419 - DNA, 30 bp, Homo sapiens; identical to SEQ ID NO: 40879
  misc_feature 1..30: note = chr6:119824210-119824240
  misc_feature 1..30: note = Hypo
  source 1..30: mol_type = genomic DNA

SEQ ID NO: 126420 - DNA, 30 bp, Homo sapiens; identical to SEQ ID NO: 94657
  misc_feature 1..30: note = chr6:119849249-119849279
  misc_feature 1..30: note = Hypo
  source 1..30: mol_type = genomic DNA

SEQ ID NO: 126421 - DNA, 280 bp, Homo sapiens; identical to SEQ ID NO: 94658
  misc_feature 1..280: note = chr6:119888178-119888458
  misc_feature 1..280: note = Hypo
  source 1..280: mol_type = genomic DNA

SEQ ID NO: 126422 - DNA, 45 bp, Homo sapiens; identical to SEQ ID NO: 94659
  misc_feature 1..45: note = chr6:119958265-119958310
  misc_feature 1..45: note = Hypo
  source 1..45: mol_type = genomic DNA

SEQ ID NO: 126423 - DNA, 30 bp, Homo sapiens; identical to SEQ ID NO: 40882
  misc_feature 1..30: note = chr6:119989053-119989083
  misc_feature 1..30: note = Hypo
  source 1..30: mol_type = genomic DNA

SEQ ID NO: 126424 - DNA, 30 bp, Homo sapiens; identical to SEQ ID NO: 94661
  misc_feature 1..30: note = chr6:121193323-121193353
  misc_feature 1..30: note = Hypo
  source 1..30: mol_type = genomic DNA

SEQ ID NO: 126425 - DNA, 29 bp, Homo sapiens
  misc_feature 1..29: note = chr6:121370472-121370501
  misc_feature 1..29: note = Hypo
  source 1..29: mol_type = genomic DNA
tgctggccagatcccgcaataataaataa

SEQ ID NO: 126426 - DNA, 30 bp, Homo sapiens; identical to SEQ ID NO: 94663
  misc_feature 1..30: note = chr6:121654694-121654724
  misc_feature 1..30: note = Hypo
  source 1..30: mol_type = genomic DNA

SEQ ID NO: 126427 - DNA, 57 bp, Homo sapiens; identical to SEQ ID NO: 94664
  misc_feature 1..57: note = chr6:121758249-121758306
  misc_feature 1..57: note = Hyper
  source 1..57: mol_type = genomic DNA

SEQ ID NO: 126428 - DNA, 417 bp, Homo sapiens; identical to SEQ ID NO: 94665
  misc_feature 1..417: note = chr6:121758539-121758956
  misc_feature 1..417: note = Hyper
  source 1..417: mol_type = genomic DNA

SEQ ID NO: 126429 - DNA, 30 bp, Homo sapiens; identical to SEQ ID NO: 94667
  misc_feature 1..30: note = chr6:122021822-122021852
  misc_feature 1..30: note = Hypo
  source 1..30: mol_type = genomic DNA

SEQ ID NO: 126430 - DNA, 36 bp, Homo sapiens; identical to SEQ ID NO: 94671
  misc_feature 1..36: note = chr6:122931170-122931206
  misc_feature 1..36: note = Hyper
  source 1..36: mol_type = genomic DNA

SEQ ID NO: 126431 - DNA, 411 bp, Homo sapiens; identical to SEQ ID NO: 94672
  misc_feature 1..411: note = chr6:122932059-122932470
  misc_feature 1..411: note = Hyper
  source 1..411: mol_type = genomic DNA

SEQ ID NO: 126432 - DNA, 1020 bp, Homo sapiens
  misc_feature 1..1020: note = chr6:123316893-123317913
  misc_feature 1..1020: note = Hyper
  source 1..1020: mol_type = genomic DNA
tcatataagttcctccggaggcttaatcatcagtacattgtcttggaaccactctggtgttttctaaattaaatatctctgtctacaacaaatgcgaaaagtacagaatgtttccgtactccttctacatcaaaattgcctcctacaggaacgagaaaatgcgtgtcaatgtgaattaccgtctacaacagctactctccaggctgatctggggtcttgcacacaaagggcgaagagaggggcgtggggaggctggaaagcatggttgccccgcctggcccggcgacgcccgctcagcagcctgctgaggagtggggacgaagagcagcctaaacttagggctcgggatatttcgatgccacccaaattgccgtcctaccccaacgaggcagggaaaggagcggagcgcgcgcgcgagctgagtgagtgcttacgtcgcagcgagatctgtgctgggataattagagaggagttgggctgagccgagtcctctttcagcagcagcagccggagccgccgccgcagcccggtggggcaaccctgactcggaccgctcgggagagccccaggagaggccagcgccgcgcagcagccgccccgctgcgcccacctccccggctgctcccggagggctcacaaaggcggtggccgcccgagtggccttctccatccaggcgttcgcgtcctcctccccaccttctctcccgaaggcgaaaatggcagggccaggcgagaacctgggacagcggtggccctagccctgcgatcctcacccctcctgctaggagaggctgcgggctgcccgcggacgatgtggccgcggctgctcccgagcgcatcttcggcccgggtccccgccgccacccctcttctctgctccttccatcccgcccagaggagttgatgccgctgtcgccgccgccgccgctgctgaagccgcggctgatggatgccagggagtgccgcattgcttagcgaccccgcctctgggtttgctggtaggagcggctgctctttctt

SEQ ID NO: 126433 - DNA, 30 bp, Homo sapiens; identical to SEQ ID NO: 94676
  misc_feature 1..30: note = chr6:124012649-124012679
  misc_feature 1..30: note = Hypo
  source 1..30: mol_type = genomic DNA

SEQ ID NO: 126434 - DNA, 793 bp, Homo sapiens; identical to SEQ ID NO: 94677
  misc_feature 1..793: note = chr6:124124293-124125086
  misc_feature 1..793: note = Hyper
  source 1..793: mol_type = genomic DNA

SEQ ID NO: 126435 - DNA, 79 bp, Homo sapiens; identical to SEQ ID NO: 94678
  misc_feature 1..79: note = chr6:124734409-124734488
  misc_feature 1..79: note = Hypo
  source 1..79: mol_type = genomic DNA

SEQ ID NO: 126436 - DNA, 30 bp, Homo sapiens; identical to SEQ ID NO: 94679
  misc_feature 1..30: note = chr6:125013668-125013698
  misc_feature 1..30: note = Hypo
  source 1..30: mol_type = genomic DNA

SEQ ID NO: 126437 - DNA, 77 bp, Homo sapiens; identical to SEQ ID NO: 40885
  misc_feature 1..77: note = chr6:125081173-125081250
  misc_feature 1..77: note = Hypo
  source 1..77: mol_type = genomic DNA

SEQ ID NO: 126438 - DNA, 20 bp, Homo sapiens
  misc_feature 1..20: note = chr6:125088325-125088345
  misc_feature 1..20: note = Hypo
  source 1..20: mol_type = genomic DNA
caccgcgcccggccctattt

SEQ ID NO: 126439 - DNA, 61 bp, Homo sapiens; identical to SEQ ID NO: 30799
  misc_feature 1..61: note = chr6:125282732-125282793
  misc_feature 1..61: note = Hyper
  source 1..61: mol_type = genomic DNA

SEQ ID NO: 126440 - DNA, 1172 bp, Homo sapiens
  misc_feature 1..1172: note = chr6:125283133-125284305
  misc_feature 1..1172: note = Hyper
  source 1..1172: mol_type = genomic DNA
gggctgtaggtgaagcgcggggagagggaggtcgcccgctccggcctctcccccaggggccctgcggctggccagcgctccggctgcacctcctggtgcgcgccgcggcggcgccacaggcccctcgaccctttgaccaccgccctcgggccgcgcgtccggcagccgggaccggtgatggcgcgggactgacggccgtctcctcccagacccctctgtcccgcctggggctcgctggggctgcggcgccgccccgagctgcatgtggggcgggcgcgcccgagcccagagcgagcggccctcggcgcccccgaggcggtgccccgccgcgccagagtacgaggaggagcggcgggccgggccaggctccccacgcgccgcagcctcggagcacgggctccccggaggggacttggggcgtcccagcccaggaggaaggacccggaagcagaagcggagccgcgagtcgagccgagccactgcccccgctgcccgcgggcgccgggtgggggtcccggcggctggatgggcagcggcggcgcgggccgcgggcggcgatgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttcccc

SEQ ID NO: 126441 - DNA, 39 bp, Homo sapiens; identical to SEQ ID NO: 94685
  misc_feature 1..39: note = chr6:125286425-125286464
  misc_feature 1..39: note = Hypo
  source 1..39: mol_type = genomic DNA

SEQ ID NO: 126442 - DNA, 162 bp, Homo sapiens; identical to SEQ ID NO: 94686
  misc_feature 1..162: note = chr6:125397724-125397886
  misc_feature 1..162: note = Hypo
  source 1..162: mol_type = genomic DNA

SEQ ID NO: 126443 - DNA, 366 bp, Homo sapiens; identical to SEQ ID NO: 94687
  misc_feature 1..366: note = chr6:125420809-125421175
  misc_feature 1..366: note = Hyper
  source 1..366: mol_type = genomic DNA

SEQ ID NO: 126444 - DNA, 241 bp, Homo sapiens; identical to SEQ ID NO: 94688
  misc_feature 1..241: note = chr6:125474789-125475030
  misc_feature 1..241: note = Hyper
  source 1..241: mol_type = genomic DNA

SEQ ID NO: 126445 - DNA, 174 bp, Homo sapiens
  misc_feature 1..174: note = chr6:125475547-125475721
  misc_feature 1..174: note = Hyper
  source 1..174: mol_type = genomic DNA
agggagtgagaggatcgcccgccgagggggtggctccgcagcccggctgcgcgagacgcttcccgctcggggacccgccttccgaggccaggtgaacgttaccggccccctgacctccagcagatccacacgtgagtcccggtttccgcgatcggggagcgacctctgcctccc

SEQ ID NO: 126446 - DNA, 168 bp, Homo sapiens; identical to SEQ ID NO: 30804
  misc_feature 1..168: note = chr6:125684529-125684697
  misc_feature 1..168: note = Hyper
  source 1..168: mol_type = genomic DNA

SEQ ID NO: 126447 - DNA, 29 bp, Homo sapiens
  misc_feature 1..29: note = chr6:125737982-125738011
  misc_feature 1..29: note = Hypo
  source 1..29: mol_type = genomic DNA
atcctctcagccaggcgcagtggctcaca

SEQ ID NO: 126448 - DNA, 245 bp, Homo sapiens
  misc_feature 1..245: note = chr6:126068007-126068252
  misc_feature 1..245: note = Hyper
  source 1..245: mol_type = genomic DNA
ctaagccttccctttcgctgaaaaggttgtcgcagaagggcggggaggcttgaaatcccgccgttccctcattctttctcttttctttctctccacataacgcctcccctacacctccccacctccaatccactaccgtatttaagtcggcgggggcgctttaaagggtttcctgtgtctgtttctgtctctctgacccgaaacgcactttcggttatagacagacaaggcgctcaaccaaggga

SEQ ID NO: 126449 - DNA, 1162 bp, Homo sapiens; identical to SEQ ID NO: 94694
  misc_feature 1..1162: note = chr6:126068780-126069942
  misc_feature 1..1162: note = Hyper
  source 1..1162: mol_type = genomic DNA

SEQ ID NO: 126450 - DNA, 30 bp, Homo sapiens; identical to SEQ ID NO: 94695
  misc_feature 1..30: note = chr6:126070219-126070249
  misc_feature 1..30: note = Hyper
  source 1..30: mol_type = genomic DNA

SEQ ID NO: 126451 - DNA, 148 bp, Homo sapiens; identical to SEQ ID NO: 94696
  misc_feature 1..148: note = chr6:126071185-126071333
  misc_feature 1..148: note = Hyper
  source 1..148: mol_type = genomic DNA

SEQ ID NO: 126452 - DNA, 193 bp, Homo sapiens; identical to SEQ ID NO: 94697
  misc_feature 1..193: note = chr6:126235500-126235693
  misc_feature 1..193: note = Hypo
  source 1..193: mol_type = genomic DNA

SEQ ID NO: 126453 - DNA, 30 bp, Homo sapiens; identical to SEQ ID NO: 94699
  misc_feature 1..30: note = chr6:126274515-126274545
  misc_feature 1..30: note = Hypo
  source 1..30: mol_type = genomic DNA

SEQ ID NO: 126454 - DNA, 337 bp, Homo sapiens
  misc_feature 1..337: note = chr6:127439190-127439527
  misc_feature 1..337: note = Hyper
  source 1..337: mol_type = genomic DNA
gaaggtcaggaaagccgggaacaagtcagcagccagaaactctccagcgatctgccaagggggagagggtagttgcgcgccggcgctggggatggggtgggggcgctggggcacaagggcgcaggggcgcacggccaccgacagccgggtgcgcctagcttgaggccgcggagaggagccgaactgggatgggtggggggtcttcggcctcaacactgcctgccagccccagtgcgcccaagtctccccgccagagctgcccttctggaggggctcttcgcacgcactgctttccccattcttctggctggaattctccggccgtcactgcagtgtc

SEQ ID NO: 126455 - DNA, 2555 bp, Homo sapiens
  misc_feature 1..2555: note = chr6:127439783-127442338
  misc_feature 1..2555: note = Hyper
  source 1..2555: mol_type = genomic DNA
cctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaagtaagtgcagggttttttacgcgtttgctccctcccgccgcgttcacctgtcgggtcgctttgcctgtccggagccggctcccaactgcagcggtcctcccgccctgcgcctcgcagaggagatgcaggttcgggctttgggggtatggacggcgtctttcacccttgcctctcggcgcccctgccttccgcagcatcctagccggtgcgaggggcgggcggacgcggcgctaaggtggctcccgccccatggtaacttcaggttcgcgggaaagttcggtcctgggttagactcgcacccgggatttgtgctttccttttgaggatcggacaggggcacccagccgaaggcacttgggactcccagacgcaggatgcctctgaccgctgagtaaatgacaagggaggcgcggccgcggtacccgctcacctagcgcaaccgcctcgcgcggggagacctcggctgggcccttaggctggactccggtagccgaacgcccgctacccggccaggaagccagggagcgagcgcctgcgcggccgcatccccgacacgcaccagcggagccaaagggcgcgcgaggcgatggggttcgcgtgtctgcgcgtttgcagagctgccggacgtcccccgcccgagggttgaagacagcaaaaccccagctgtggggagccggaggtgcggagtttccaggttctctcttgtcacatgtgagcgtctgtaccatctctggccctttcaagtgtgtcccctgggacacacacgtacagagagtggggtctccctaaagattcgcctcctcgctgcccttaatgctgttatttggagggttggattgtgatggcttcttaagacggtgtcctagctggaattaagcggacaccaccacggcagcctcaacctgggttggtctgtctgaaaggtagaatcttcccaagatgaagggacagatgcgaaggtgtcacctctcctcgctccagggtagcctggcgccctcgctgctctagtgtctgtgttcccatggggagtcctttcgcagatctcagagcaggggcgaccctggctctatggttgggggcgctggtggagagagggaggaggaaacttctcctggagctcgcgaggggcaggaagcgatgctgctgctctgggctctcgcacctccgcggcgtgcagcccaggcccagcggccccacctggtttcccaaggggatccctctcccagcgtcccgcccgggaagcctttcggggcagacgtcggggcagcgcggaggacacaacaccggcttgtgtgagatggaaatttagtaatcgcttctcggccgctgtttgtccctgccctgcccctgggcatgagggtcccctgaaagctccctttgtattgctggcctcggccagacaaggtttgattcacctgaaaattgccttttaaaaaggtggcagtgccagagcgacaggggccctggccgggcctcaccgcctttaggatcacctagcagggggcaggagagcccaaactaaatatgtcagggcatccgatttattattcttggcctccgaatggtgtgtactctggtaactccccacccactctttcattccggcccggacgcggaaggggaggcctggggttcagcggtgtccacgcgcctggcggtccccgcctcctctcctcccagggtctggcctggggaattgagtctcagggtcagtgggcatagggagcccgggctggagcgcaacccactctgctttccatccgctcttccagcccgtgcccattgggcgtcccagagcacgctctctcctttacccccaccgaggacccccgggctgggagccacacacttgtcaaggagggacagggtactgagtgtcagaggcgtctcgctttgcagttttg

SEQ ID NO: 126456 - DNA, 50 bp, Homo sapiens; identical to SEQ ID NO: 30816
  misc_feature 1..50: note = chr6:127442649-127442699
  misc_feature 1..50: note = Hyper
  source 1..50: mol_type = genomic DNA

SEQ ID NO: 126457 - DNA, 213 bp, Homo sapiens; identical to SEQ ID NO: 94712
  misc_feature 1..213: note = chr6:127836013-127836226
  misc_feature 1..213: note = Hyper
  source 1..213: mol_type = genomic DNA

SEQ ID NO: 126458 - DNA, 1084 bp, Homo sapiens; identical to SEQ ID NO: 94713
  misc_feature 1..1084: note = chr6:127836665-127837749
  misc_feature 1..1084: note = Hyper
  source 1..1084: mol_type = genomic DNA

SEQ ID NO: 126459 - DNA, 972 bp, Homo sapiens
  misc_feature 1..972: note = chr6:127839721-127840693
  misc_feature 1..972: note = Hyper
  source 1..972: mol_type = genomic DNA
acttctcagcagaggcgaggtttccaagtagctgaacaaatcaacagcactttccttctgatattccggggatctcagggtttattattgtgcctttctgcgccgaggaaagttcaacttcatattattgtatgcgactttccggctgagcatgactttgggctcgctcgccgcagttccacacccactcgatttctccaaacaatggcggtaacgtcaagattcagctgcccccagagcgggtgacttcccggcggtccgcggctgggctggagctgcagctctcagcaggctaacacgcgaggtaccaagctgggccagacgctccccaggaagtgcagagatgttcatgagctgacctcaccgaactgggcaggagagaaggcgggattgcaagggacgatagggtagaagtaaccaaagagaggttactttcaagaggaaagagaagaaggcggggagggggacgggggacgggggtggggagtggcgggataaagagacaaaaaggccagagccacgcccgagatggaagattggcagcagcgctcaaactccttgctctattctcttatcccgtacttggcagaggatcccaaaaccgctcgaacacggatgcactggtttcctgcaaagctttgtcctgggttcggtcattctccatcaattatttacttgagcttcttttccaaggaggcggactagaacagccttccgggcgtgactaacatctcctgatgcagctggctggcggctgctgggagttctctttgttcactcactttaattctcagtcgagctctacacgcggtgctccctccccacccccagcccgggcggagtcatcagatgtcgtttccacgaatagataatggttgccatgatgggacccaccgtcccacagacaaagggttcttgcgaagccacgactaatttagtgcaaaccgaaataaatatcggcccacagagatc

SEQ ID NO: 126460 - DNA, 48 bp, Homo sapiens; identical to SEQ ID NO: 94716
  misc_feature 1..48: note = chr6:128840325-128840373
  misc_feature 1..48: note = Hyper
  source 1..48: mol_type = genomic DNA

SEQ ID NO: 126461 - DNA, 64 bp, Homo sapiens; identical to SEQ ID NO: 94717
  misc_feature 1..64: note = chr6:128841037-128841101
  misc_feature 1..64: note = Hyper
  source 1..64: mol_type = genomic DNA

SEQ ID NO: 126462 - DNA, 142 bp, Homo sapiens; identical to SEQ ID NO: 94718
  misc_feature 1..142: note = chr6:128841577-128841719
  misc_feature 1..142: note = Hyper
  source 1..142: mol_type = genomic DNA

SEQ ID NO: 126463 - DNA, 390 bp, Homo sapiens; identical to SEQ ID NO: 94719
  misc_feature 1..390: note = chr6:128901705-128902095
  misc_feature 1..390: note = Hypo
  source 1..390: mol_type = genomic DNA

SEQ ID NO: 126464 - DNA, 399 bp, Homo sapiens
  misc_feature 1..399: note = chr6:129204289-129204688
  misc_feature 1..399: note = Hyper
  source 1..399: mol_type = genomic DNA
ccagcagctgctgctcgctcagctcacaagccaaggccaggggacagggcggcagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtacagtcgaggcatgggcttgggttgcatcctttgccgggaccgagattcctcacttcttccactcttccgagagttgctgtctgtggactgccgtcttgcttcgccttcagagagtgcgctctggggcaagaggaacttgaagcaagttcaagttcaatgccatgagagcgtagtgtaggggga

SEQ ID NO: 126465 - DNA, 57 bp, Homo sapiens; identical to SEQ ID NO: 94722
  misc_feature 1..57: note = chr6:129480603-129480660
  misc_feature 1..57: note = Hypo
  source 1..57: mol_type = genomic DNA

SEQ ID NO: 126466 - DNA, 30 bp, Homo sapiens; identical to SEQ ID NO: 94723
  misc_feature 1..30: note = chr6:129958014-129958044
  misc_feature 1..30: note = Hypo
  source 1..30: mol_type = genomic DNA

SEQ ID NO: 126467 - DNA, 248 bp, Homo sapiens; identical to SEQ ID NO: 94724
  misc_feature 1..248: note = chr6:130088218-130088466
  misc_feature 1..248: note = Hyper
  source 1..248: mol_type = genomic DNA

SEQ ID NO: 126468 - DNA, 30 bp, Homo sapiens; identical to SEQ ID NO: 40889
  misc_feature 1..30: note = chr6:130182604-130182634
  misc_feature 1..30: note = Hypo
  source 1..30: mol_type = genomic DNA

SEQ ID NO: 126469 - DNA, 30 bp, Homo sapiens; identical to SEQ ID NO: 40890
  misc_feature 1..30: note = chr6:130241934-130241964
  misc_feature 1..30: note = Hypo
  source 1..30: mol_type = genomic DNA

SEQ ID NO: 126470 - DNA, 114 bp, Homo sapiens; identical to SEQ ID NO: 94728
  misc_feature 1..114: note = chr6:130339570-130339684
  misc_feature 1..114: note = Hyper
  source 1..114: mol_type = genomic DNA

SEQ ID NO: 126471 - DNA, 30 bp, Homo sapiens; identical to SEQ ID NO: 94730
  misc_feature 1..30: note = chr6:130465678-130465708
  misc_feature 1..30: note = Hypo
  source 1..30: mol_type = genomic DNA

SEQ ID NO: 126472 - DNA, 39 bp, Homo sapiens; identical to SEQ ID NO: 94731
  misc_feature 1..39: note = chr6:130499389-130499428
  misc_feature 1..39: note = Hypo
  source 1..39: mol_type = genomic DNA

SEQ ID NO: 126473 - DNA, 149 bp, Homo sapiens; identical to SEQ ID NO: 40891
  misc_feature 1..149: note = chr6:130530028-130530177
  misc_feature 1..149: note = Hypo
  source 1..149: mol_type = genomic DNA

SEQ ID NO: 126474 - DNA, 30 bp, Homo sapiens; identical to SEQ ID NO: 94733
  misc_feature 1..30: note = chr6:130608796-130608826
  misc_feature 1..30: note = Hypo
  source 1..30: mol_type = genomic DNA

SEQ ID NO: 126475 - DNA, 1541 bp, Homo sapiens
  misc_feature 1..1541: note = chr6:130686377-130687918
  misc_feature 1..1541: note = Hyper
  source 1..1541: mol_type = genomic DNA
gtaacctgaacctctcgttggctttgatgtttggagtcgaacatccgcactgctcatcgaagacccccgtgcttcagttccctctgtcttccatttcccccgcccatggttctcgcccccccaagccgttctccggaaccccttgccgggccggcgggaagcgtggaccgagcgggccttggccgcgtcttttccggccaggtttggtttagctcgcgcagcgcccgcgcagcccgccagggggaccccggcccgccgggcggcatctgaggagaaagcgtccgaggggcgtggagccagggtcctgcggtgcctgctccgggaatactgcgagtcggctggagctccccagccgctccggagaactgggggagccgggtccctggctcggtaaccggtggtcccgcggtagctagaggcgggccccacgggtgggtgtgtccgtttccgcacgccagccttccagcccgggaagagcgcctgcaagcgggtactttgttcccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcccgttcccggtcccttttgtctttcttggacgcggtggcggcgccgcctgagcggcgactccctctcccctgcccggcttgctgcgcccggtgccctccgagggcaggcgcgcctggactctgcgcccggatggcggcggccctctgtgagcaccggcagcggcgcatcccctgccccgaggcctccggtgcccccccggcgcgggcataggggcgcccccaccctccgtccgcttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacaggtgaggggaaggaaagggtgctgacgggagtggggaggtgggtgggcggccaccgcagccgaaaccgggcacttcttcagccctctgccctcccctcccctccgctacagcctccagagttaggtaaacgctgtctctcctaaagtttgggaaataaaccaagtccgccatcaggtccagactccccagtcccgggagcgcgagagaagccgtgcggggcagcctccaagaacccggagtactggagcg

SEQ ID NO: 126476 - DNA, 30 bp, Homo sapiens; identical to SEQ ID NO: 40892
  misc_feature 1..30: note = chr6:130808098-130808128
  misc_feature 1..30: note = Hypo
  source 1..30: mol_type = genomic DNA

SEQ ID NO: 126477 - DNA, 30 bp, Homo sapiens; identical to SEQ ID NO: 94740
  misc_feature 1..30: note = chr6:131269546-131269576
  misc_feature 1..30: note = Hypo
  source 1..30: mol_type = genomic DNA

SEQ ID NO: 126478 - DNA, 18 bp, Homo sapiens
  misc_feature 1..18: note = chr6:131389805-131389823
  misc_feature 1..18: note = Hypo
  source 1..18: mol_type = genomic DNA
cctcgggaggctgaggca

SEQ ID NO: 126479 - DNA, 69 bp, Homo sapiens; identical to SEQ ID NO: 94745
  misc_feature 1..69: note = chr6:131455780-131455849
  misc_feature 1..69: note = Hypo
  source 1..69: mol_type = genomic DNA

SEQ ID NO: 126480 - DNA, 21 bp, Homo sapiens
  misc_feature 1..21: note = chr6:131532615-131532636
  misc_feature 1..21: note = Hypo
  source 1..21: mol_type = genomic DNA
tgtaatccagatgggcgcggt

SEQ ID NO: 126481 - DNA, 181 bp, Homo sapiens; identical to SEQ ID NO: 94747
  misc_feature 1..181: note = chr6:131602777-131602958
  misc_feature 1..181: note = Hyper
  source 1..181: mol_type = genomic DNA

SEQ ID NO: 126482 - DNA, 89 bp, Homo sapiens; identical to SEQ ID NO: 94748
  misc_feature 1..89: note = chr6:131616389-131616478
  misc_feature 1..89: note = Hypo
  source 1..89: mol_type = genomic DNA

SEQ ID NO: 126483 - DNA, 41 bp, Homo sapiens; identical to SEQ ID NO: 94752
  misc_feature 1..41: note = chr6:131884134-131884175
  misc_feature 1..41: note = Hypo
  source 1..41: mol_type = genomic DNA

SEQ ID NO: 126484 - DNA, 86 bp, Homo sapiens; identical to SEQ ID NO: 94753
  misc_feature 1..86: note = chr6:132017843-132017929
  misc_feature 1..86: note = Hypo
  source 1..86: mol_type = genomic DNA

SEQ ID NO: 126485 - DNA, 158 bp, Homo sapiens; identical to SEQ ID NO: 94754
  misc_feature 1..158: note = chr6:132128512-132128670
  misc_feature 1..158: note = Hyper
  source 1..158: mol_type = genomic DNA

SEQ ID NO: 126486 - DNA, 30 bp, Homo sapiens; identical to SEQ ID NO: 30828
  misc_feature 1..30: note = chr6:132271740-132271770
  misc_feature 1..30: note = Hyper
  source 1..30: mol_type = genomic DNA

SEQ ID NO: 126487 - DNA, 1018 bp, Homo sapiens
  misc_feature 1..1018: note = chr6:132722029-132723047
  misc_feature 1..1018: note = Hyper
  source 1..1018: mol_type = genomic DNA
gtctattaagtggggcgctggggacaggaaagtgttcaaagaaggaaacctgcctggggtcatccgtgctcggcttccctaccgcgcgccttctggggctccgggagagcaggcgctgcccgcggaggcgagagtgagcgtggccgggggcgcggggctgcgccaggtgagagagagctgcgggccccggggacgacccgcacctgcgccctctctggggtccggacgggaccgggctcggccgggcgggctccgggaggagacgcgcttacctggaggtagggccgcccgtgggccaccccgcccacgacgatgtcggcggacgccatggccccggtgggcgagaagccgaagcccacgtagcctgcagtgcgcacctggaggcggaaggcgatctggctgccccgctggctccagcccagccagtacttgccctccgagtccaggagggtccggtgcggataggttcggcccgagccccccgccgccgtcccggggagcagcccccacagcaggagcagcggccagcagcacatcctcgggcgcctcctgcccgccggtaccggcctccagccgctggggagtgaggagcagaacgaggagcggcagcggcggcgagcgggagcccagggaccgcccctcgggccggccgcgcgcccgcccgggaggggcaggacccgctctccccgccccgggccgcctgcagggcgcgccgcgtcccgtccggtcccgtcccgttccgtcccgtcgggtcccagccccgccaactctcaccctgcccggcccttccagcggatccacttgcagcccccgacccctgacttggtccccgaggtcggggctcggtgggaaggaaagcgaggggcttcccggaaagaaagggaggaggaggcaggaggaggcagacgccgagagaggagaaaaggaggccagaggcagagggaaaaggaggagggcaagagaatcctagagcgggaagagcgtgggctctgcgggacgtgggcgagaggttaccagg

SEQ ID NO: 126488 - DNA, 2541 bp, Homo sapiens
  misc_feature 1..2541: note = chr6:133561700-133564241
  misc_feature 1..2541: note = Hyper
  source 1..2541: mol_type = genomic DNA
ctagagaagctctgacgccgccttggaagtaagtcgttgctgcctgacctttgggcgtctgggacggatgcctatacctgcacccagcagcactggaaggggcccaggcccttcgcagcacagcctatccccagaccgcttagtccttcataacatatatctccacggaaaagggtatttcctcccgtcagaaaaagcgccccagtctggtctgggttggtttttatttcacgttgttgcaagtaggcgaagtcccttctgtctcctcccttggggtaagtggaaaggagtccggcagggggcccgcagtggcctgcacaggggaactgggtagcgagagagttccaggcaattccgggggctgccccacagaagcaggtggggatcgacagtggctctccggcccagggaggagagcgcggtcgcgggtccctcccctcagcctggaggctgcagccgctcgagtcggcccgggtgggggcggggtgggggcggcgcggagggcacggagattacggcggcgccacccgggacatccagggccccgaggccctgggcggtccccacgcgagatcgcaaaccatgacaataggcagtcacccgaggtcaaataaaaacggagtgggtcccccgcgcgccgccgccccccgcgtccctggcggcctcccccgaggcccccggcggcctcacgagcccgcagtagccggtggcgacgtcgcccccgccccacctccctgcgcaagtgcgaggctgccggcagcgcggcgcacgctccggccgttcccggcttccgcgcaaaacttccatcctgtccacgtgaagttgtcgctgccttagagagggggaaagagctgcgggaaaagccggggagtgacgactgcggcggctgggcgcgctctctcattttcttttcttctcctttcccccctgtcgcagtccggagttttggctcctctcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgaggtgagtgaccccttcttccaacccccgccccagggctcccgggggagcctgagttgagagaacccccaaactttccgggaaagtgcgcgaggctccgccggggacgccgagcgctgggtactgaggacgcgcagctggacggtgcgtgggcgcctgcgtccccggggggcgcttggaggccgggtgccccacgcctgagggcccgggccgctcggaccgcagcggtgctctctgccctagaagacgtccccaagccccaagggtcccttccgagcctgcctgtcccttccggggtcggcgcggagcctgcgcgtaacggagttcatccagcagtccagcgcgcggcttctacctgcaccccgcctccacctggcagaggcgcgagcatcggggtctcccccacatctttcttatgacgtgtattactttctgatgaccccctagatggtccaggcgcgaggatgctgacccagagtccttcggagggtcacaggcgcctgggctttcccggtgccgggtgcgtgtgtactttaaaggctcgcgttctaatctccaggcactgatcgggcttttcaactgcggcgatcccactttaatagtttttatgtggcgtggactgaatgtctcctgcagtttgccagggtcggtgaaattagaggcgccttgtcagagcagtcgcgttcattggctcgagtagcgggtgccatggaaggcttataacttctccaaaggaagggacctggctgggtagagcaggtttttctctccttccaagcctgctgggtctggggaggcagtggaacttgaaatggctcggatttttagcgtggtgaagcgaggtttggaagtagacgtgtgtgtgcttgttttattctgcgccgcacagcaacccgaactttcgtttggtagcacttgaaagagttttctccctttgtttgcgagattctgaacagctcggagcgattagggaatttgcggaccgagtccggtggcagagctggggcgaaagcagagagcgcaatttaatttttgtcatctcttccctgcttgggaggatagtgtttcccttcaccaccacccctctttctccttcctatgaagacaacggatttgcgcctggggtgagagtgtgtgcgggagagtggtgtggagactgtcctctctcaccgcgtctcctgcgcctctccccgccatcccgagcgggcctagagagtcattcatgaatcttaacctgagggcaggggaggaaggtgcaggtccctctgccctttctgccaaggtgcagaatagcgcccgggcgtgtgttttggttccagagcagttccacgtggagcaacttcgtgtgtgtgtgtgt

SEQ ID NO: 126489 - DNA, 30 bp, Homo sapiens; identical to SEQ ID NO: 94764
  misc_feature 1..30: note = chr6:133894955-133894985
  misc_feature 1..30: note = Hypo
  source 1..30: mol_type = genomic DNA

SEQ ID NO: 126490 - DNA, 93 bp, Homo sapiens; identical to SEQ ID NO: 40896
  misc_feature 1..93: note = chr6:134067455-134067548
  misc_feature 1..93: note = Hypo
  source 1..93: mol_type = genomic DNA

SEQ ID NO: 126491 - DNA, 170 bp, Homo sapiens; identical to SEQ ID NO: 94766
  misc_feature 1..170: note = chr6:134175884-134176054
  misc_feature 1..170: note = Hyper
  source 1..170: mol_type = genomic DNA

SEQ ID NO: 126492 - DNA, 1179 bp, Homo sapiens
  misc_feature 1..1179: note = chr6:134210188-134211367
  misc_feature 1..1179: note = Hyper
  source 1..1179: mol_type = genomic DNA
tgggctgcaaggatccgcccctctattccccagataaattcctagtgtccaccaaattcctcagcgctcgctcaccctcctctacggccacgactctgggagtggggaaacagagagccggttcctctgctgcagaagtcctcggggttccttctcacaactctgcgaaggggaaagggttgtgagacccaaccagaccccaactccagctcccagcaggaggtggctgcgccacactcgggaggcctcttggtttcagggtctctctgtctctctctcaccctcttcctcgctttctctgtctctctgtctctctctctctctctccctcgtccactcccccaaacatgtccaccggctccctcagcgatgtggaggaccttcaagaggtggagatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgcccaccaagaagagccccctgagcggggtcagccaggaggggaagcaggtccagcgcaacgccgccaacgcgcgagagcgggcccgcatgcgagtgctgagcaaggccttctccagactcaagaccaccctgccctgggtgccccccgacaccaagctctccaagctggacacgctcaggctggcgtccagctacatcgcccacttgaggcagatcctggctaacgacaaatacgagaacgggtacattcacccggtcaacctggtgagtgctcccggggctgcagctgcagtccaggcgcgcccgcactcccgcctgcggtgggcgcgagtgcgcgcggggctgggagtgggggtgtgggcgcggcggtgacttacacatctcgaccaccgcgggcctagagcctccagggaccggaggcgggcggtctagacacggccctcgctctctgccctaccagcccccggagcgggagtgatttatgcgagggtttgacgtggcagcccaattaaaagtttgcaagtgtgttgagctggcacagaggagggatcccccgctcccgctccatcgccatcctccctggggtgcagtggctgctgcggaactgagaacactgacaagacgctgcgagcggacaggcattttg

SEQ ID NO: 126493 - DNA, 113 bp, Homo sapiens; identical to SEQ ID NO: 94769
  misc_feature 1..113: note = chr6:134212308-134212421
  misc_feature 1..113: note = Hyper
  source 1..113: mol_type = genomic DNA

SEQ ID NO: 126494 - DNA, 486 bp, Homo sapiens
  misc_feature 1..486: note = chr6:134213916-134214402
  misc_feature 1..486: note = Hyper
  source 1..486: mol_type = genomic DNA
ttctaacaataaacccgcatgcctgccttttggttgctgttagcgggtgcgtttagctcccgccacgacttccggcggactgggtttaatttaaacattttccaggctacggaacagctcctaagggaagattaagttgagataaacagagaagcaaggccgaggagcctgcgacccgggtccctcactgccccagcgcagcccgcggcggccgatgcgccagatgccaccggggctgtttaatgttcggggttatgaccgcagtgtttacaagacgtcttcggttatttatactgttattcctcgcagagagccttgaaacttccgcttcatttgctctttcttttcgattttttacccttttttctcggcttagtttggtacctggagcgagagcttctccgcccttccaccaaccccacaggccgcttcgcgggtggagccctctgcctggccatggaggaaggatcccgctaggctggtccc

SEQ ID NO: 126495 - DNA, 97 bp, Homo sapiens; identical to SEQ ID NO: 8736
  misc_feature 1..97: note = chr6:134216904-134217001
  misc_feature 1..97: note = Hyper
  source 1..97: mol_type = genomic DNA

SEQ ID NO: 126496 - DNA, 91 bp, Homo sapiens; identical to SEQ ID NO: 30841
  misc_feature 1..91: note = chr6:134217370-134217461
  misc_feature 1..91: note = Hyper
  source 1..91: mol_type = genomic DNA

SEQ ID NO: 126497 - DNA, 299 bp, Homo sapiens; identical to SEQ ID NO: 30842
  misc_feature 1..299: note = chr6:134499553-134499852
  misc_feature 1..299: note = Hyper
  source 1..299: mol_type = genomic DNA

SEQ ID NO: 126498 - DNA, 86 bp, Homo sapiens; identical to SEQ ID NO: 40897
  misc_feature 1..86: note = chr6:134589500-134589586
  misc_feature 1..86: note = Hypo
  source 1..86: mol_type = genomic DNA

SEQ ID NO: 126499 - DNA, 86 bp, Homo sapiens; identical to SEQ ID NO: 40898
  misc_feature 1..86: note = chr6:134589886-134589972
  misc_feature 1..86: note = Hypo
  source 1..86: mol_type = genomic DNA

SEQ ID NO: 126500 - DNA, 296 bp, Homo sapiens; identical to SEQ ID NO: 94777
  misc_feature 1..296: note = chr6:134638707-134639003
  misc_feature 1..296: note = Hyper
  source 1..296: mol_type = genomic DNA

SEQ ID NO: 126501 - DNA, 39 bp, Homo sapiens; identical to SEQ ID NO: 94781
  misc_feature 1..39: note = chr6:136443399-136443438
  misc_feature 1..39: note = Hypo
  source 1..39: mol_type = genomic DNA

SEQ ID NO: 126502 - DNA, 20 bp, Homo sapiens
  misc_feature 1..20: note = chr6:136556311-136556331
  misc_feature 1..20: note = Hypo
  source 1..20: mol_type = genomic DNA
gccaccgcacctggcctgat

SEQ ID NO: 126503 - DNA, 137 bp, Homo sapiens; identical to SEQ ID NO: 40899
  misc_feature 1..137: note = chr6:137144480-137144617
  misc_feature 1..137: note = Hypo
  source 1..137: mol_type = genomic DNA

SEQ ID NO: 126504 - DNA, 1428 bp, Homo sapiens
  misc_feature 1..1428: note = chr6:137241818-137243246
  misc_feature 1..1428: note = Hyper
  source 1..1428: mol_type = genomic DNA
ctttggctgaagtgtcgcgttcagcacagaggtggaagtaagaggcagaaaacagaagaaccacgagagaaatggatcctgtctattaaggcaacgtgatgcagcgctaaaaggttaggaggttacgattcccggggctaagagaaataaactgctggtggtgaacgaaaggggtgctggagcgcagcgatctcgaacctttcccttatagccaaaccctggccaaggccacaaatttcaaatcgcctgaaaaccaaactgtctggcgcttaacggttacctcggctgagcgaaacccttggctgctgctgatttaactacaggtccgcgcgagttactttccagggaactgaattcagaacaaagagttaccgaagccttactccctctccaaaattagaattccctttttctcttagtcatataggaaacacacagttcacaagtcctgtggtgcaaaggtgtgaaccctggcccagggaggtggtgactctccccgccctccgcctgccggttgtcctgcttccgaaagcaacccacgacggtcccgcagggtgagggttccctgggatcagttccctgggatccggagaacgccacgcggagtctccctgcagggtgaggggccccgggttcccgccccctccccctctactctcccattctgcgagcgcagccagcctcccctcccacgcttcgggaagcgtcgcccccgagctcctcggttcctggtggtggctactcgtgttagtgacttcgtttctgcgcgtttgcttattttcatctttgcctcagttcgaatgtgtccccgccaccaggccccgctgctgggcgagaccactgaaccccctgaaagcttccccggagccgcgcgcataatcccgggaccctctctggaaggcgtgcggagagcggtgcgcgtggcctggcaccggaaggagccagcttccgggctccgaggcaccccctggacagcgccccgggccgcgggttcctcctccgatgcccgggcgtcgtcgccgggatcgggagcttcgggggcccgccggcaccgacggttttcgcttccctggcgggcagctggacgaggtcccgccgctgcaccgggagggacagtgggtggaaaaagccgctgcagcgccggggcgagggggctgggggcgccgtcacttgttgcgaccaataaacggcgctcgatcctgatgcgctgtttctaaaatctttagctgtgtcccgatccctccaacccaagcccctcggccaggaggaaggggcaagcgagagccgctggctctgtggggggagaggggcgccgcgccccaagagcccccgtcccgccctgcggcagccgccccggggcgcccagccgcccgcttccctccgcagagcgtcttccctgacggtgaaaccgcgcgggacacaacccac

SEQ ID NO: 126505 - DNA, 1495 bp, Homo sapiens
  misc_feature 1..1495: note = chr6:137243458-137244953
  misc_feature 1..1495: note = Hyper
  source 1..1495: mol_type = genomic DNA
cgccgccgcgctgggcgggcgcccccgccgccctcactccgctgctcccggctcctcgcgcgcaggtcgcggagctccgccaccgctgggtgcggcgaggccggcgcgatgcggcagctgtgccggggccgcgtgctgggcatctcggtggccatcgcgcacggggtcttctcgggctccctcaacatcttgctcaagttcctcatcagccgctaccagttctccttcctgaccctggtgcagtgcctgaccagctccaccgcggcgctgagcctggagctgctgcggcgcctcgggctcatcgccgtgccccccttcggtctgagcctggcgcgctccttcgcgggggtcgcggtgctctccacgctgcagtccagcctcacgctctggtccctgcgcggcctcagcctgcccatgtacgtggtcttcaagcgctgcctgcccctggtcaccatgctcatcggcgtcctggtgctcaagaacggcgcgccctcgccaggggtgctggcggcggtgctcatcaccacctgcggcgccgccctggcaggtgagcgggcccccgcgccgacccccagccgaccccacccaccccgctccgtcgggcagagaccgcggggatcactgagttcaacgacctcacttccagatggggagactgaggcagagagagccggagagctttgagagtggtcgctcagctcgcaaaagggacttccgagacccagagagctccccagcgccccaccaagtccccctgccccctaatgtcctggcttccgaccctcgcccatgcttcacccggcatcgcccttcctgtcgccccctctcctggtcttcccctgtcaccccattctccgggagaggtgggagggccgcctgagcctgggagctggagtcctccaagcctggaccaagccggaaggagggggccgtgaacttccttgggtcacgaggggctggaatggaggtgggggatgggggcgaagctgagggttcccggggctactgcggggtgtctcgtgctgcgcagggggctgcggccctggggcagacgacccaggtgctgagcgagacgagagcctgggcagggggaagcttcactgggggccagaacaggcgttctcccccgcgcctggcccgctccgggttgcaggccactggctggggctccctctccctttggtgccccacggggcaggggctccggggtgcaggtaccacgcgcccaagtgacctcggtgccagctcggggaagccacagcacctgccccgagggcatctgcgctctccggggcctttgtcttggacagaggaagatggagtgacccggggatatggcgggaaggcgctctgagcactgagtttggctgtcgcatttgacacgggtggccgagggacggcgggcgtctgtcactcaggaatccggtgggcagagctggggcgcgaacccagtctcctttcctacccgacgcgttttccccgtgggtccccgccc

SEQ ID NO: 126506 - DNA, 89 bp, Homo sapiens; identical to SEQ ID NO: 94788
  misc_feature 1..89: note = chr6:137310853-137310942
  misc_feature 1..89: note = Hyper
  source 1..89: mol_type = genomic DNA

SEQ ID NO: 126507 - DNA, 222 bp, Homo sapiens; identical to SEQ ID NO: 30851
  misc_feature 1..222: note = chr6:137311158-137311380
  misc_feature 1..222: note = Hyper
  source 1..222: mol_type = genomic DNA

SEQ ID NO: 126508 - DNA, 46 bp, Homo sapiens; identical to SEQ ID NO: 94790
  misc_feature 1..46: note = chr6:137365956-137366002
  misc_feature 1..46: note = Hyper
  source 1..46: mol_type = genomic DNA

SEQ ID NO: 126509 - DNA, 40 bp, Homo sapiens; identical to SEQ ID NO: 94791
  misc_feature 1..40: note = chr6:137366320-137366360
  misc_feature 1..40: note = Hypo
  source 1..40: mol_type = genomic DNA

SEQ ID NO: 126510 - DNA, 2542 bp, Homo sapiens
  misc_feature 1..2542: note = chr6:137808752-137811294
  misc_feature 1..2542: note = Hyper
  source 1..2542: mol_type = genomic DNA
ggaggagaaaggagtcgccataaaatgcacccgcgccaccctccatgtcccccagtggaattgaggatcttgcttgtggcaaaagtgcgttcttggcaccacagccccgcagctggggaggggggcctcagtacccggcttccgcaattttccaggcgtggaggtgaggggtgcttgcgtgtaaactgtggcaacccccagaatcaggccctggctcctgcactttcggaggtgtctgttgcagaccacgaggaaaagaggggtcttactcaagtcagggccggacagaactccaaaacttacgaggacagctatccaacactgcctcacagacccttaggcgctgccccctctttgcccctgtcctcctgcggtgcgagaaacccgaccactctgcttctacccgaaccccaggacgcaacagtaaaatcaaggcccgtcgttgaactcccaggtctgcgcatccctccctcctggctccctggggtcttggccccagcaggtccagtacccatccccagagggacccactaccctgggcgtcccagggtgccaggcacgatggcctgcaatgggggctgcaatttaaccgaggcgagttaaattccttttgccggtgcctggctgcgaggacaaacgtccgtactttcgttcgggagccacgggcagtccaggggcttgggttagaagcaacggctctcttccaggggctgtgatccgggtcggccagggagagcgaggccccggggtcctctgtgaggtccccagcgaagagacgcagctggggaaggcgccgcccccgggccccctgcgccaccctaaccgggcctctccttagcaaagttgacaaattcttgagagtgtcagcccagggctgcgcgtgagggcgctgggaccggggaggaaagagcacctgccgcgctcagcccgactttgaatttgtttgttgttaccgtttttgtttttcctcccagtttccataaacgcttagtatttcgaggcactttgcaggtgttggcgcaggtgatgatgggcctcgttggactctgcctcccacgcatccttttgttttctgcgcgccagcctgtctgactgtgtcctgcggggaccccgagacagtccggggtcagggcgtagagactcatgcttgccacttgacccatccgcaacccggggaccccctagcccgtcgcggagctggagtttgggcttccggctcccagctctccgccctggatacaggaagagggcgggagaggtcgcgcacccgcgccgctcggcggggatcgctcacaggggctccggggccaccgcgagcgcggactgcggctgctggcgggctccttcgtcgtccaacgcaccccatcctctcccgccccgcagtgtcccagggaaggcttcactgaaaacagacgctcgacggaaaactgactctgcaggcccgagctttcggagtttgatttctgtgggccccttaaacgggcactgggtacaggagaggccccaactctctgcagggacggggagggaagggcactcactctcccgcaagttttcctagaggcgagctgaagatgcaggccacctccctcccgcacggcccctcccttggcctagttctgtccaaagacacttcccagccctcgagcggcggctcctccactcgattcctgcctacacgtgaagagcttggacccagcggggctgcactcgggaggacaggcccagatcctgcacggccgggaggacacctggccccgctgtcttctcttcacagctcccctttctcggcttcggcctggagcggtgcagggaggggtggacctggggtggccttaagatatctagcctgggtgcggagacttgggagcccacccttagcagtcactcctcctccccagtggagggtgagaaaaggggaacagagggccccggagtctctggaagggacgtggaacgcgaagttaaatgttggtgtctgagcgatgtgctggtggggcagagggggttccagcgtcctcccagagtgaggaggcttttgcaatttctgctgaatgcgtcagtggaggcacaaaaccttgcttgacctagcagctgggaaaaaaagaagttcgaggggacacaaggccccctgctgctggagcgaggaaaccctgggcttggccagctcgggccgcttctccctgcccgtttgcgggctgtcggcctcagcggtcccagaaacaaagatctagtgagcccagccgacgccggcctcattttccctttctaagggtcactttcttccgccctctaaattaggtcatcgcctgggaaagcgccgagaggtttctagtgtgggcttctcaaggtgtctccgcccaggaggatttcgccatccatttaaacgtaaggcggggtttaatctggaatgaaaggatcgtcgtggtgtttccagattgaatgaaaaactaaacttgcaaaatttcgagaaagtgacaagtttacaacgaaaaaaaatcccggccgaaacccattttcacctttgcggtcatgaaatctt

SEQ ID NO: 126511 - DNA, 2415 bp, Homo sapiens
  misc_feature 1..2415: note = chr6:137813536-137815951
  misc_feature 1..2415: note = Hyper
  source 1..2415: mol_type = genomic DNA
agagagagccaaccccgcatgcagaataactgagcgagggggggtggcgcaagctactagagggagcccaggcttttacaatagcggccccagaacagcaaaggaaggttccgaataaagtttgaagggggtgggggtgggagaagaagcgcgtgtgcgtgagtgtgggtctttgcactctgccccttttttcatttcatacaaccacagacagatatatggagtacttgggataattcactaataaatccttgttacaaggaaaacggcaccacagcctgcacgacatattcagacaagattcatttagaagcgtgcatgcattcttttgacctacactgcgtcgaaaggaaaacccacataggaggtgtcatgccctggacctcggttgagattcaaaacttgggtcttgatctctctcgcgctctctctctctttctctctccattgtctctagaaaaactgtggcaaggacagagacaatcataatcgcatccatctcaagaaaatatttacatttgttttgcacaaaagggatggccgtctttttccaaagcgagaacacagagtcagagaaagccaactcaaaagtcccttcgcaagtttttaactacaccgatcccatctttatacaacaaatgcagttttgacaagagcatatggcagtgaaaaatactggcgcggcatggggaaaagaagcatgcatgcaaaacacacgacatctggttcgagtccccctttgctaccacctagaaattgcggtttgattttggtcctttccctccgggggtcaagtggagtctgagatctctcagacagcgtgggaggctgcgggccccggagcctgccctcccgtgggccgagcgtgcagcctccctcttccctcccggcccggcaccgcggcccctcccgccgctctccctcctccttggcagccgggcccgcccgctgctcacttgagcaagtccttggactcggccgacagccgggccatgttggctgtggagagagcggacaggtgcggcggcggcggcatctggcagatggtgcaggggcagggcagaccagcccagtgctggaagccgctgcccagctgcagcgcgggcggcgtggagggcgccttgagtagcgagtggggaggccggatggtgccgatggcgggaagtgaggcggcggacagcggtgacgaggcgttgccagatgagagcgcgccgcccaagatggggtgcaccgggtgcacggagttggccgcgtgcgcggggtggccggccgagtggcccacggtcccgcagtgaaaggccgagtggtggcccccatagatctcgccaaccagcctcttcatctcctccagggagctggtgagcatgaggatgtagtttctggcgagcaggagtgtggcgatcttggagagcttgcgcaccgacggcccatgcgcgtagggcatgacttcgcgcagcccgtccatggctaggttcaggtcgtgcatccgcttgcgttcgcgtccgttgatcttcagcctcaactgctgtaggtcctgctccgacagctgcttcttgattttgtacttgctgctctctcccgcggccttggcgccagcccgcgagaggctttccccgggcatcttctgcatcatatcgccctgcgtggacgagaccgagttgagacggctctcctggtggtggtggtggcggtggtggtggtccctcaggtacatctcatccatgtccggagatgaagctctgctggagacagagctcgaatcagaattcattttattacaggggatgcggccctaccgtggggaggctttaggcgggaaattaaagaaaatcttgaattaaaaaaaaaaaatctgcactgcccaggaacccacttctccgcggcaagacgtgagaagaaaagcggagacgctgcttttccccgcctctctccctcccacgcccctctctctggttaggctgcttcctggacagctagttggtgtgtgcttgaactaacctcacgctgaaaaagaggggcttttatagagctgcggcggagaaaagagacaaaaggagccctcctatctatcctgggctggttaggatgacgtgccatcattcagggcggtgcgctttgctgtcccatttagcaaggattcctattcatattcattgtggggccgccctgggacacctctgctccgaaccgctaggagcccccaggcacaaaaccctctgattgacacactcaccgctccagcttacgccttcctgattttttttttaactttcttccaccccaccccccttcccaatttctctaaccaaatcacacatcaggaacggaaggaaggcaagagaaggtggccaggcggttggtggaggttcctctgagtttggagagaggaattgaaacattcgctctcctttcttt

SEQ ID NO: 126512 - DNA, 815 bp, Homo sapiens; identical to SEQ ID NO: 94800
  misc_feature 1..815: note = chr6:137816459-137817274
  misc_feature 1..815: note = Hyper
  source 1..815: mol_type = genomic DNA

SEQ ID NO: 126513 - DNA, 2143 bp, Homo sapiens
  misc_feature 1..2143: note = chr6:137817618-137819761
  misc_feature 1..2143: note = Hyper
  source 1..2143: mol_type = genomic DNA
agtggctagtcctaacgacaaccctctgcgactcccctgctgatcaaatggggtgaggagagagaggcggacgggggagggcattgggagcgagcactggactggacgaagagcagcttccccgccctgcggacggtgcacaggtctggcccccgccgtcctcctgagccacctccctgaccctaggtcgtcggcggcgtctgtccttcccacacccagactgaaaacgctgcacctgagttttgatttggggaagtagaattgtctggtcagagcagaagggttgcaaatgaaggagtggaaaaatcatgttgctacaagatattttaccctttaaaaaaagtcttgattttcccagtggacaatgtaaaataaagttttaaaatctcccccaaattagtaacgaaggtggcaagccgtgggcggggggaggggagggaaggagggtagagcagccctcgaaatacaagcttgcggggctggaagtccggggccagggttctgggagtccaaaccagaagccactctccttcagcacagcctttcagccgagagggggctgacgcctgccgcagccggttccgagggggctgcgatgggccgggaaggggcgactgggcctttgcccgaacagaccaggacattcccttccttcttccctaagggttttcagctccagtaacagaggtgcctgaaatgggagatctgcggggaccaggccgggactccctggctccgaggccgggacgtggcgcgccctccgctcctcggtcaccctctgctttttcgaaggtccgtaatgcgtgagtgtgggtggtccaaggttcagggcctccttccagtaagtacttttagaagctagttcccccacttcccatccgttgcggggcttgacaactagacgaggggagtgagtaaaggtgccacaactttgcttaccgtaaaatgggttaatactcgccggggcccaaaaggctgagtcgccccgcacgtcttgcttcgtggagtctcttttcgacccccgccaccgcagctcagttcctcggattgagccctgaacccgagaaggagcaggcccggagctcaggagggcaggcacacggatttctttctgagggctgactaccaacgcccaccccagacttgtacggaaggagagagtaaaggagtcgccgcctggccaaggctgcagcagcctacagaggctcagccggagacgcaccatgaccttggccctggccgagacccctttcggagggctcagaccggcgaggagccggagcgagcgaccctgctgcggtggctcgggctgcgctctctcgggccacaccccgcgccctcgcggctggggcgggctgcgccgcggaggcggggatcgttctccggcaacaggtgcgtcccaaggcaggcaggctacttccctccaagcctgtcttggctctgagaagagcctggagtttctcagccttcctacaacatatgaaaacagcgggtcggcgcgtggaccggggcagaagagccgtcctgctgtacccgcgcgcccagggcgctccgcggggaccgcgcactcgggaagctgtgctgtgctcaacacccccctgtgcctcccagatcaccagggatcgtctcttacctgacacccagtgcgcgccgctcggtgcccgacgcccactgctccgcagccttagccaccgagttcctctccagcagctgccggctctgcctgaggccgcggcgattttggctcaggagcgaacccccacccccacccccgcaagagtccagtagcaaatgtcgctagctgacctgccgaagagctactgtgagaggcaggtcaatcagcaacgtccaggggctcctctcgctcatcaagcagcaaacttgaccagcagaaactttggccgagaccgaaaggcgggaggctgccctgtgggcttcacctttcaacccaaccaccctccaagacaaaacagaacaaaaaaaggaaacctaaacatttctaactatgtttcctcatgtgcaaacaaggaatagcctaaaaattagttgaccacgcggagaaacttctcaaaaagtgcattctttagcagagtagaacgataacttcacaacaatagcagtgggggtccggtcaccagggccg

SEQ ID NO: 126514 - DNA, 38 bp, Homo sapiens; identical to SEQ ID NO: 94815
  misc_feature 1..38: note = chr6:138753177-138753215
  misc_feature 1..38: note = Hypo
  source 1..38: mol_type = genomic DNA

SEQ ID NO: 126515 - DNA, 157 bp, Homo sapiens; identical to SEQ ID NO: 94816
  misc_feature 1..157: note = chr6:138790419-138790576
  misc_feature 1..157: note = Hypo
  source 1..157: mol_type = genomic DNA

SEQ ID NO: 126516 - DNA, 30 bp, Homo sapiens; identical to SEQ ID NO: 94826
  misc_feature 1..30: note = chr6:139645132-139645162
  misc_feature 1..30: note = Hyper
  source 1..30: mol_type = genomic DNA

SEQ ID NO: 126517 - DNA, 33 bp, Homo sapiens; identical to SEQ ID NO: 94827
  misc_feature 1..33: note = chr6:139720812-139720845
  misc_feature 1..33: note = Hypo
  source 1..33: mol_type = genomic DNA

SEQ ID NO: 126518 - DNA, 408 bp, Homo sapiens; identical to SEQ ID NO: 94831
  misc_feature 1..408: note = chr6:142409841-142410249
  misc_feature 1..408: note = Hyper
  source 1..408: mol_type = genomic DNA

SEQ ID NO: 126519 - DNA, 30 bp, Homo sapiens; identical to SEQ ID NO: 94832
  misc_feature 1..30: note = chr6:142444970-142445000
  misc_feature 1..30: note = Hypo
  source 1..30: mol_type = genomic DNA

SEQ ID NO: 126520 - DNA, 249 bp, Homo sapiens; identical to SEQ ID NO: 94833
  misc_feature 1..249: note = chr6:142622714-142622963
  misc_feature 1..249: note = Hyper
  source 1..249: mol_type = genomic DNA

SEQ ID NO: 126521 - DNA, 334 bp, Homo sapiens; identical to SEQ ID NO: 94835
  misc_feature 1..334: note = chr6:143247641-143247975
  misc_feature 1..334: note = Hyper
  source 1..334: mol_type = genomic DNA

SEQ ID NO: 126522 - DNA, 108 bp, Homo sapiens; identical to SEQ ID NO: 94836
  misc_feature 1..108: note = chr6:143248343-143248451
  misc_feature 1..108: note = Hyper
  source 1..108: mol_type = genomic DNA

SEQ ID NO: 126523 - DNA, 312 bp, Homo sapiens; identical to SEQ ID NO: 94837
  misc_feature 1..312: note = chr6:143557301-143557613
  misc_feature 1..312: note = Hypo
  source 1..312: mol_type = genomic DNA

SEQ ID NO: 126524 - DNA, 30 bp, Homo sapiens; identical to SEQ ID NO: 94838
  misc_feature 1..30: note = chr6:144277296-144277326
  misc_feature 1..30: note = Hypo
  source 1..30: mol_type = genomic DNA

SEQ ID NO: 126525 - DNA, 144 bp, Homo sapiens; identical to SEQ ID NO: 94839
  misc_feature 1..144: note = chr6:144521927-144522071
  misc_feature 1..144: note = Hypo
  source 1..144: mol_type = genomic DNA

SEQ ID NO: 126526 - DNA, 55 bp, Homo sapiens; identical to SEQ ID NO: 94840
  misc_feature 1..55: note = chr6:144607633-144607688
  misc_feature 1..55: note = Hyper
  source 1..55: mol_type = genomic DNA

SEQ ID NO: 126527 - DNA, 152 bp, Homo sapiens; identical to SEQ ID NO: 94841
  misc_feature 1..152: note = chr6:144622994-144623146
  misc_feature 1..152: note = Hypo
  source 1..152: mol_type = genomic DNA

SEQ ID NO: 126528 - DNA, 149 bp, Homo sapiens; identical to SEQ ID NO: 94842
  misc_feature 1..149: note = chr6:146349147-146349296
  misc_feature 1..149: note = Hyper
  source 1..149: mol_type = genomic DNA

SEQ ID NO: 126529 - DNA, 282 bp, Homo sapiens; identical to SEQ ID NO: 94843
  misc_feature 1..282: note = chr6:146349511-146349793
  misc_feature 1..282: note = Hyper
  source 1..282: mol_type = genomic DNA

SEQ ID NO: 126530 - DNA, 454 bp, Homo sapiens; identical to SEQ ID NO: 94844
  misc_feature 1..454: note = chr6:146755460-146755914
  misc_feature 1..454: note = Hyper
  source 1..454: mol_type = genomic DNA

SEQ ID NO: 126531 - DNA, 117 bp, Homo sapiens; identical to SEQ ID NO: 94845
  misc_feature 1..117: note = chr6:146864391-146864508
  misc_feature 1..117: note = Hyper
  source 1..117: mol_type = genomic DNA

SEQ ID NO: 126532 - DNA, 116 bp, Homo sapiens; identical to SEQ ID NO: 30871
  misc_feature 1..116: note = chr6:146864762-146864878
  misc_feature 1..116: note = Hyper
  source 1..116: mol_type = genomic DNA

SEQ ID NO: 126533 - DNA, 113 bp, Homo sapiens; identical to SEQ ID NO: 94847
  misc_feature 1..113: note = chr6:147828093-147828206
  misc_feature 1..113: note = Hyper
  source 1..113: mol_type = genomic DNA

SEQ ID NO: 126534 - DNA, 246 bp, Homo sapiens; identical to SEQ ID NO: 94848
  misc_feature 1..246: note = chr6:147829255-147829501
  misc_feature 1..246: note = Hyper
  source 1..246: mol_type = genomic DNA

SEQ ID NO: 126535 - DNA, 39 bp, Homo sapiens; identical to SEQ ID NO: 94849
  misc_feature 1..39: note = chr6:147829759-147829798
  misc_feature 1..39: note = Hyper
  source 1..39: mol_type = genomic DNA

SEQ ID NO: 126536 - DNA, 74 bp, Homo sapiens; identical to SEQ ID NO: 94850
  misc_feature 1..74: note = chr6:147830039-147830113
  misc_feature 1..74: note = Hyper
  source 1..74: mol_type = genomic DNA

SEQ ID NO: 126537 - DNA, 113 bp, Homo sapiens; identical to SEQ ID NO: 94851
  misc_feature 1..113: note = chr6:147830462-147830575
  misc_feature 1..113: note = Hyper
  source 1..113: mol_type = genomic DNA

SEQ ID NO: 126538 - DNA, 30 bp, Homo sapiens; identical to SEQ ID NO: 94852
  misc_feature 1..30: note = chr6:147886875-147886905
  misc_feature 1..30: note = Hypo
  source 1..30: mol_type = genomic DNA

SEQ ID NO: 126539 - DNA, 30 bp, Homo sapiens; identical to SEQ ID NO: 40903
  misc_feature 1..30: note = chr6:147981884-147981914
  misc_feature 1..30: note = Hypo
  source 1..30: mol_type = genomic DNA

SEQ ID NO: 126540 - DNA, 457 bp, Homo sapiens; identical to SEQ ID NO: 94854
  misc_feature 1..457: note = chr6:148663337-148663794
  misc_feature 1..457: note = Hyper
  source 1..457: mol_type = genomic DNA

SEQ ID NO: 126541 - DNA, 156 bp, Homo sapiens; identical to SEQ ID NO: 94855
  misc_feature 1..156: note = chr6:148664007-148664163
  misc_feature 1..156: note = Hyper
  source 1..156: mol_type = genomic DNA

SEQ ID NO: 126542 - DNA, 163 bp, Homo sapiens; identical to SEQ ID NO: 94856
  misc_feature 1..163: note = chr6:149068767-149068930
  misc_feature 1..163: note = Hyper
  source 1..163: mol_type = genomic DNA

SEQ ID NO: 126543 - DNA, 320 bp, Homo sapiens; identical to SEQ ID NO: 94857
  misc_feature 1..320: note = chr6:149069188-149069508
  misc_feature 1..320: note = Hyper
  source 1..320: mol_type = genomic DNA

SEQ ID NO: 126544 - DNA, 38 bp, Homo sapiens; identical to SEQ ID NO: 94858
  misc_feature 1..38: note = chr6:149069731-149069769
  misc_feature 1..38: note = Hyper
  source 1..38: mol_type = genomic DNA

SEQ ID NO: 126545 - DNA, 99 bp, Homo sapiens; identical to SEQ ID NO: 40904
  misc_feature 1..99: note = chr6:149177471-149177570
  misc_feature 1..99: note = Hypo
  source 1..99: mol_type = genomic DNA

SEQ ID NO: 126546 - DNA, 71 bp, Homo sapiens; identical to SEQ ID NO: 94860
  misc_feature 1..71: note = chr6:149460105-149460176
  misc_feature 1..71: note = Hypo
  source 1..71: mol_type = genomic DNA

SEQ ID NO: 126547 - DNA, 23 bp, Homo sapiens
  misc_feature 1..23: note = chr6:149498669-149498692
  misc_feature 1..23: note = Hypo
  source 1..23: mol_type = genomic DNA
aattctccatccaatcgagtctt

SEQ ID NO: 126548 - DNA, 34 bp, Homo sapiens; identical to SEQ ID NO: 40907
  misc_feature 1..34: note = chr6:149772982-149773016
  misc_feature 1..34: note = Hypo
  source 1..34: mol_type = genomic DNA

SEQ ID NO: 126549 - DNA, 192 bp, Homo sapiens; identical to SEQ ID NO: 94863
  misc_feature 1..192: note = chr6:149785967-149786159
  misc_feature 1..192: note = Hypo
  source 1..192: mol_type = genomic DNA

SEQ ID NO: 126550 - DNA, 20 bp, Homo sapiens
  misc_feature 1..20: note = chr6:149868358-149868378
  misc_feature 1..20: note = Hypo
  source 1..20: mol_type = genomic DNA
gccaccgcacctggcggaaa

SEQ ID NO: 126551 - DNA, 23 bp, Homo sapiens
  misc_feature 1..23: note = chr6:150069440-150069463
  misc_feature 1..23: note = Hypo
  source 1..23: mol_type = genomic DNA
tgagactccgtctcaatcaaaag

SEQ ID NO: 126552 - DNA, 85 bp, Homo sapiens; identical to SEQ ID NO: 94867
  misc_feature 1..85: note = chr6:150204851-150204936
  misc_feature 1..85: note = Hypo
  source 1..85: mol_type = genomic DNA

SEQ ID NO: 126553 - DNA, 425 bp, Homo sapiens; identical to SEQ ID NO: 94868
  misc_feature 1..425: note = chr6:150243820-150244245
  misc_feature 1..425: note = Hyper
  source 1..425: mol_type = genomic DNA

SEQ ID NO: 126554 - DNA, 125 bp, Homo sapiens; identical to SEQ ID NO: 94869
  misc_feature 1..125: note = chr6:150246750-150246875
  misc_feature 1..125: note = Hyper
  source 1..125: mol_type = genomic DNA

SEQ ID NO: 126555 - DNA, 143 bp, Homo sapiens; identical to SEQ ID NO: 94870
  misc_feature 1..143: note = chr6:150262701-150262844
  misc_feature 1..143: note = Hyper
  source 1..143: mol_type = genomic DNA

SEQ ID NO: 126556 - DNA, 1972 bp, Homo sapiens
  misc_feature 1..1972: note = chr6:150284667-150286639
  misc_feature 1..1972: note = Hyper
  source 1..1972: mol_type = genomic DNA
gaggcaaaaaaggttcgctccggaatggggaagcggctgcgccctggacggagaggggcggggacttcgcgactgcaggcggagggagggcgggtgtcgctggcgcaggcggtgacagggagacaccgccgccactgagtattcctatgcaagtttcttcatcttcctgtgcatcagtgtttacactggggtaatgataaatgctgtgttgaaaaattatttgatggggccatggaaggaacggaaggaacggcgtcctggcccgctcggggcccgcgcacgccgccaccaagccgcgggggcgggtcggaggggagagttgcgtcagccaggccgctgtcagatgacgagcccggggcgtgacggggtggagcatccccaaaaaagtgcatgcctaggatcccgcccagtgtatccctgcgcgcggcgggccgggctgggcagctttataaacagccgtggtgtgagcctcgaagggaaccatcagcgcctcctgtccacggagctccaggtctacaatggcagcggccgccagccccgcgttccttctgtgcctcccgcttctgcacctgctgtctggctggtcccgggcaggatgggtcggtgagttcggggatgtagcctaagcagggcgggggccaaacctgggaggttgtggactgcagcgggtttcagaggaggggaggcttctggaaggaccggcgcgatctccctgaacgaacatcgcggtctccccgaacgtcgcggtccctccgaacgtcgcggtctccccgaacatcgcggtgcccccgaacatcgctgtctccccgaacatcgcgatctccccgaacatcgtgatctccccagacatgcccagctgaaggcactcagttcccctcggtggctcctttccgccgggtccgcttcctgcggctgctgcttgcccctcaggccaggaggtttctggaaggaccggtgctgtctccccgaacatcgtggtctccccgaacatcgcggcctctccgaacatcgccctctctccgagcaacgcgatctccccgaacatcgcggtctccccgaaaatcgcgatctccccgaacattgccatctcaccgaacatcgcgatctcgccgaacatgcccggctgaaggcactcagttcccctccgcggctcctttccgccgggtctgattcctgcggctgctgcttgccccgcaggccaggaggcttctggtagcaccggcgcgatgcccccgaacatcgcgttctaccccaacatcgcgatccctccgaacatcgtgatcccccccgaacatcgccgtccccccgagtaacgcggtctccccgaacatcgcggtccccccgaacatcgcggtacccccgaacatcgccgtctccccgtacattgcgatcccccgaaacattgcgatctccccgaacatcgcgatctcgccgaacatgcccggctgaaggcactcagttcccctccgcggctcctttcctccgggtccgcttcctgcggctgctgcttgccccataggccaggaggcttctgggtggaccagcgcgatctccccgaatatcgcggtctacccgaacatcgcggcctccccgaacatcgcggtctccccgaacatcgcgatcccccagaacatcgcggcctccccgaacatcgcggtctccccgaacatcgcgatcccccagaacatcgcggtctacccgaacatcgcggcctccccgaacatcgcggtctccccgaacatcgcgatcccccagaacatcgcggtctccccgaacatcgctgtctccccgaacgtgcctggctgaaggcactcagttcccctccggggctcctttccgccgagtccgcttcctgcagctgctgctagcaccgcagtccagggggagtgtcaaagaaggctgaaaaggaattgcaggagggtggagggaccaaaaggctacagagggcaaggtagggcggggatccctggtg

SEQ ID NO: 126557 - DNA, 109 bp, Homo sapiens; identical to SEQ ID NO: 94874
  misc_feature 1..109: note = chr6:150310096-150310205
  misc_feature 1..109: note = Hyper
  source 1..109: mol_type = genomic DNA

SEQ ID NO: 126558 - DNA, 39 bp, Homo sapiens; identical to SEQ ID NO: 94875
  misc_feature 1..39: note = chr6:150310414-150310453
  misc_feature 1..39: note = Hyper
  source 1..39: mol_type = genomic DNA

SEQ ID NO: 126559 - DNA, 373 bp, Homo sapiens; identical to SEQ ID NO: 94876
  misc_feature 1..373: note = chr6:150311072-150311445
  misc_feature 1..373: note = Hyper
  source 1..373: mol_type = genomic DNA

SEQ ID NO: 126560 - DNA, 462 bp, Homo sapiens; identical to SEQ ID NO: 94877
  misc_feature 1..462: note = chr6:150311753-150312215
  misc_feature 1..462: note = Hyper
  source 1..462: mol_type = genomic DNA

SEQ ID NO: 126561 - DNA, 98 bp, Homo sapiens; identical to SEQ ID NO: 94878
  misc_feature 1..98: note = chr6:150312685-150312783
  misc_feature 1..98: note = Hyper
  source 1..98: mol_type = genomic DNA

SEQ ID NO: 126562 - DNA, 929 bp, Homo sapiens
  misc_feature 1..929: note = chr6:150358524-150359453
  misc_feature 1..929: note = Hyper
  source 1..929: mol_type = genomic DNA
gccaatgagagtggacgcaggcaggggcgggggagcctttcacacatgacttttcatggtttcgatcctgatacacgtgaatatatggaggtgaagtagtaaggaagggtggggccgggagccccggcgacggtcaccagttgagctcgcctgatctgttgtgggctacgagagtccggggacgggcaatctgggcagagtcgcacgaggctgctgcagtgatgaggcactggttctagaaatttacccaacggtgttgtcataggggggacattacaggtgattgctgatttcaaccacagatgactttcggggaaagttctctcctgggggtttctgtttctaccccgccgcgtcctctccgagttctgcgcgctcctcccagggcgcccgctgtccccgagctctggacccgggtcctgcccagtggagaccgcggagttggtgccccgcttgcggccgatgctcccgggcctccgagtccacagcgtccggacaaaacggcctttggaagacctgggaggactcgccggtagcggcaagggaaggagccaggaaatgcgggggtcggtggggtgaggagcacggggttcctacttcatcctcgcggaaactttgccaccggctcagtgtggagacctcaccgtcccgcttggatccgtggggctccggcagtgtggcctccgcgaggacccccatcctccttgccctggggatgctgcgggagggcgcccgggccgcactaggtcctgagtgtccagggtccggcaggggcttcccgttgtcgcctccccgaccccgccgctcgcggtccagggctcctggtttctccactgggctgggggcccggagcatggacgtcgtgaggcggagaaaaccttgggatgggtggaaaagaaggatcggagagagggcgggagaaagggaga

SEQ ID NO: 126563 - DNA, 30 bp, Homo sapiens; identical to SEQ ID NO: 94882
  misc_feature 1..30: note = chr6:150393330-150393360
  misc_feature 1..30: note = Hypo
  source 1..30: mol_type = genomic DNA

SEQ ID NO: 126564 - DNA, 20 bp, Homo sapiens
  misc_feature 1..20: note = chr6:150487217-150487237
  misc_feature 1..20: note = Hypo
  source 1..20: mol_type = genomic DNA
tttttttttttgagacggag

SEQ ID NO: 126565 - DNA, 30 bp, Homo sapiens; identical to SEQ ID NO: 40909
  misc_feature 1..30: note = chr6:150985942-150985972
  misc_feature 1..30: note = Hypo
  source 1..30: mol_type = genomic DNA

SEQ ID NO: 126566 - DNA, 61 bp, Homo sapiens; identical to SEQ ID NO: 94887
  misc_feature 1..61: note = chr6:151346311-151346372
  misc_feature 1..61: note = Hypo
  source 1..61: mol_type = genomic DNA

SEQ ID NO: 126567 - DNA, 1631 bp, Homo sapiens
  misc_feature 1..1631: note = chr6:151560965-151562596
  misc_feature 1..1631: note = Hyper
  source 1..1631: mol_type = genomic DNA
tccgtggcctgactgcgttaacctctcggttccctgctcttgccacgtgaggtgcccaaatatggtcggactcaggaggagccagggagcgcttgcctttctcctgctaatggggaggaggctggaacaaatgtttggagttaaacacaatctgcaggaaagcaaatggggactcggactcgctcctgggcgagctgaaagtcggctgcagcagaagctcctgccttgggtgatccatcatttaataaaccccagagaatccagtgtccccggcaggctttttgctcccctgctctcttgccttctgaggccctgggtcgtccccgcagctctagtcgccctgttagaaacgggaggcgcccgagggccgggtgggcggctgcctggacctgggctggcgcgtcgcagcgcctctggtcccggcagcctgggggcagatgctgctgcagggcgtgtctggggctgtgctcatgtgatgaagcgagggaaaaaccggggggaggggggcggaggctaagaggtggcctttttttttttttccttttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaaggtacgggcgtgccgggccacctgcgccgggaggcgcgggtctttgggggtgggggtgggggtgggggggtccctccgatttccgccgagagaacttcccagcccatccagccgcatctgcaaactcaggagtgcgaacccctctttggaggcttttcagggtctttcgcgccggggcggggccagagcagcggcgagcgcggcggggggcttgcatctttgtcgcgggtctccaggggaggcgactgcgccatgcgcaataataaaacccgcgccctgcccacggcggctgagcctttctgcgcactcttccggtgggagccatgcagcccgaggcggaggagctgcgcggagggggatccgtggagaatggaccccgggccgggcctccggagctccgagatgcggaaagtcagctgtgaggccaggactcgtggtggagcccgccggggagcccagccaccctcgggttccccgtcgcgtaccgccctggatgccagcggtgcctggagcgagcgggtttggtacccagtcctcctgcggcagcggcccgagcaggcaccgccttcccgaggcagagaaagcctggggtgtagctcgctcagagccaggaaaaacctgggcaggcgctgcgtttccagaaggaatgacaggtttcgcaaaccagccagcgccctcgcgttcgctcagcgctttgcctgcagactcagttggccaaacacacgctagagtggctag

SEQ ID NO: 126568 - DNA, 735 bp, Homo sapiens; identical to SEQ ID NO: 94892
  misc_feature 1..735: note = chr6:151814876-151815611
  misc_feature 1..735: note = Hyper
  source 1..735: mol_type = genomic DNA

SEQ ID NO: 126569 - DNA, 34 bp, Homo sapiens; identical to SEQ ID NO: 94893
  misc_feature 1..34: note = chr6:151815845-151815879
  misc_feature 1..34: note = Hyper
  source 1..34: mol_type = genomic DNA

SEQ ID NO: 126570 - DNA, 151 bp, Homo sapiens; identical to SEQ ID NO: 40910
  misc_feature 1..151: note = chr6:152520849-152521000
  misc_feature 1..151: note = Hypo
  source 1..151: mol_type = genomic DNA

SEQ ID NO: 126571 - DNA, 30 bp, Homo sapiens; identical to SEQ ID NO: 94898
  misc_feature 1..30: note = chr6:152539785-152539815
  misc_feature 1..30: note = Hypo
  source 1..30: mol_type = genomic DNA

SEQ ID NO: 126572 - DNA, 196 bp, Homo sapiens; identical to SEQ ID NO: 94899
  misc_feature 1..196: note = chr6:152562427-152562623
  misc_feature 1..196: note = Hypo
  source 1..196: mol_type = genomic DNA

SEQ ID NO: 126573 - DNA, 579 bp, Homo sapiens; identical to SEQ ID NO: 94900
  misc_feature 1..579: note = chr6:152622914-152623493
  misc_feature 1..579: note = Hyper
  source 1..579: mol_type = genomic DNA

SEQ ID NO: 126574 - DNA, 1085 bp, Homo sapiens
  misc_feature 1..1085: note = chr6:152957418-152958503
  misc_feature 1..1085: note = Hyper
  source 1..1085: mol_type = genomic DNA
tagtagcaacagtaccgaccatcacaataagaggctggctgccttttgcttctgcaccattggagcccaggagatgtgccacaagcggaaatgacaactcagagagggggatattaatagggacatctacgtacgagatgcaaagaggctccccaacctcctagtctccttatctatgagtatcgcacacgtacacacatcactgccaccaccccctcccatcaagcacgcagagccccagcgtgcaggcacaaacttgctgacaatttgtctgcaatgtgttcgtcttgcacctctctctcctctccctgtctctgtctctccctgtctcccagtctctgtctttccttttaccttctctctcggcctcgttcagtttcccagcagcaaggcgaagcgagcgaacgcttcctcccggctctctgcgcccaggctcggcgggaccccggggatgcgcggctgtccgcccgccctgtcgccgggatcgggcgcggtctgcaggactgcgggagcccagccgccctggtgacagaggacaacaatctcagcccgctgcggccggcggccgcggcccggcgcccgcgctcaccctggctggctcgcccacactcactcccgcgccgggctgctcagccgcgctccccgccctccgcgaccggttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagagctgggggcggggacccggaggctcgcaggcttccctacctcctggagatgcacggccttgggcgtttctccgcagctgcaaagctgtgctgtgacccacccgctcagcgagcctttataccgggaccacctcccgggggtcgaggtgggaaggaaatgtccctgagagccgggacgcgctgcctccgctgcctggaggagctgcgctgtcctgccagc

SEQ ID NO: 126575 - DNA, 30 bp, Homo sapiens; identical to SEQ ID NO: 94905
  misc_feature 1..30: note = chr6:153272474-153272504
  misc_feature 1..30: note = Hypo
  source 1..30: mol_type = genomic DNA

SEQ ID NO: 126576 - DNA, 625 bp, Homo sapiens; identical to SEQ ID NO: 94906
  misc_feature 1..625: note = chr6:153450977-153451602
  misc_feature 1..625: note = Hyper
  source 1..625: mol_type = genomic DNA

SEQ ID NO: 126577 - DNA, 1165 bp, Homo sapiens
  misc_feature 1..1165: note = chr6:153451662-153452827
  misc_feature 1..1165: note = Hyper
  source 1..1165: mol_type = genomic DNA
ctggtcaaaggattcattttcgcaacctcttcttcgaacaccttccccacctgagcagtgcattttcccaaaggtaaagagagataagggaggaaacacagcacccaaggtgatcagtcgattggacactgttgatggcacattctcctcgttcccaaccaaccgcacaaaacccgcaacacctcgcgtccccgcggggtctcccgcgcccctggcccggccctcccggccgcccccagcaggcgccccgctctccgcgggaactctgggacctggccgagcgttccccggcgggcaggacactcgcccggttccctgcagcagctgagggcggcgagcggaccgcgtccaggcagcgacgcgggattcaacttcccggacccgcggcgcggcccccgctcccgctcagggcgccgcggccacagctgagaccccagcgccgcgcagccgcccccgccggggcatgggcggtcgcgctctccgccccctccttccttcacctcccccctaccttgaaaaaaatccatccattggtgcaaagcagacattttgatgtcatttacttagcaccgcttgttttggaggcagcgtcttacccggtcgcctggaggtgtgggcagcgcgccgatgggtccgggggagcggggctgggcggctcggtcctctagcggagccggtttgctgccatccgcccaacttcagcacccagcgggcgaggagagagggagagcggcgaggatgcagaggagggggagggggaggagggagcggtgggcggggagggagcgagagccgctcggcagcgcgcatgcgcctcgcgggccggcgcagcccctcgcccggcgcggccggaggggcagcttcccagcccctgcgcgcggccgcgagagtcccggccccgccccctccccgggcggcccccggccccgcccgacctcgcgcgctcgcctgggcgcggcgcccaccgtgcggaggggctcggccgggactctcggcttcggtgacgcccgtccggagcttcgcgggaggcccggagtcccgagagcttccctgggtgacagcggctctccgcccgggcccctgcaactccactcgcccgtagcccgcgcgctgctgtcctgggctgcgcgggagccttgcacccaggagccggcctgccaggcac

SEQ ID NO: 126578 - DNA, 38 bp, Homo sapiens; identical to SEQ ID NO: 94910
  misc_feature 1..38: note = chr6:153472441-153472479
  misc_feature 1..38: note = Hypo
  source 1..38: mol_type = genomic DNA

SEQ ID NO: 126579 - DNA, 377 bp, Homo sapiens; identical to SEQ ID NO: 94911
  misc_feature 1..377: note = chr6:154360574-154360951
  misc_feature 1..377: note = Hyper
  source 1..377: mol_type = genomic DNA

SEQ ID NO: 126580 - DNA, 99 bp, Homo sapiens; identical to SEQ ID NO: 94913
  misc_feature 1..99: note = chr6:154771265-154771364
  misc_feature 1..99: note = Hypo
  source 1..99: mol_type = genomic DNA

SEQ ID NO: 126581 - DNA, 62 bp, Homo sapiens; identical to SEQ ID NO: 94914
  misc_feature 1..62: note = chr6:154796421-154796483
  misc_feature 1..62: note = Hypo
  source 1..62: mol_type = genomic DNA

SEQ ID NO: 126582 - DNA, 173 bp, Homo sapiens; identical to SEQ ID NO: 94915
  misc_feature 1..173: note = chr6:154830592-154830765
  misc_feature 1..173: note = Hyper
  source 1..173: mol_type = genomic DNA

SEQ ID NO: 126583 - DNA, 103 bp, Homo sapiens; identical to SEQ ID NO: 40911
  misc_feature 1..103: note = chr6:154970495-154970598
  misc_feature 1..103: note = Hypo
  source 1..103: mol_type = genomic DNA

SEQ ID NO: 126584 - DNA, 38 bp, Homo sapiens; identical to SEQ ID NO: 94918
  misc_feature 1..38: note = chr6:155281592-155281630
  misc_feature 1..38: note = Hypo
  source 1..38: mol_type = genomic DNA

SEQ ID NO: 126585 - DNA, 1314 bp, Homo sapiens
  misc_feature 1..1314: note = chr6:155316026-155317340
  misc_feature 1..1314: note = Hyper
  source 1..1314: mol_type = genomic DNA
tgggtcttggagtgccgactcgattgccatctccgctgcgaagccatctcctctcagaaggggaaggagatggaaagtctctgcggccgctgacctcagttttgcgtgcctttcctcggtgggacccgggaagagccgtctttaaattccttggggaagggacggggtcgcactggcgcatcgcatccccggtagcgggcagagcccccagctcacagtgagcgcgtgctcgatgtttcttgaattgttttatttgtgttgttccaaagaaagcgcgagggacatggtccgggaccagccgggagctggcgcgggggtcctgggcctgacgctgggcggggctggggcgtgtccggggcggggcggggcgggaggtgcggtcgcggctcgggcctggcaggcgctgcgcgcggggctggggcagcggtaaccgtaactgtggccgcggccgccgcaggcgcacagcgcgcgtccaagtggagaacaaagtgacccccagaacttctccaactcctcccggcgttcccgcgagggccacgcgccgagggtagcggagggcggcgcgcgaccggccccaccgagcccggcgcgcgacccgaggtaaggggcgcccgggtgagggcgcaggagggcgacgacccgcgctggttggcggcggctccaggtcccctgcgggcggggcggcgcgcggccggcggtcccctcccttcccctttgttggccgcccctctctgcccccgctttcctgggagtcccgcggaaggtcgcggctgcggggcgcggcctggcaccctctccccggagggcggcagcgtccgggcacagcctggcacgggggacgaagcactttccagaaggctctgaaactaggtcccctggtcccctcgcgctgcgcgacacgccaggacccactttcagccccggtcccatcccggatgggaggaggcggcgccccggcctcctgataccgaggttctcgcccaaagccgagccgtgggtgcccggaggggagcgcccgctgcgcccacgcccgcccggcgacctcggagcctcagaaaggcgctgcggcgaagcaggatcccaggcggtcggctcagcgagtgtagaccgtgcggtccctgctcagcccctccggcctttccgagcgcgggagccatcccggacgggcgcggctcctgggggggctgaggtgccaagtttctgtgaaagccgacacgttgtgcccctaatggatcctatttaccaaaaacagttcagaaagaaaagagtccattcttccagccattcgttgctgacagccgctggaaaggtctg

SEQ ID NO: 126586 - DNA, 30 bp, Homo sapiens; identical to SEQ ID NO: 94921
  misc_feature 1..30: note = chr6:155438513-155438543
  misc_feature 1..30: note = Hypo
  source 1..30: mol_type = genomic DNA

SEQ ID NO: 126587 - DNA, 140 bp, Homo sapiens; identical to SEQ ID NO: 94922
  misc_feature 1..140: note = chr6:155568772-155568912
  misc_feature 1..140: note = Hypo
  source 1..140: mol_type = genomic DNA

SEQ ID NO: 126588 - DNA, 74 bp, Homo sapiens; identical to SEQ ID NO: 94923
  misc_feature 1..74: note = chr6:155569275-155569349
  misc_feature 1..74: note = Hypo
  source 1..74: mol_type = genomic DNA

SEQ ID NO: 126589 - DNA, 30 bp, Homo sapiens; identical to SEQ ID NO: 14887
  misc_feature 1..30: note = chr6:155988231-155988261
  misc_feature 1..30: note = Hypo
  source 1..30: mol_type = genomic DNA

SEQ ID NO: 126590 - DNA, 158 bp, Homo sapiens; identical to SEQ ID NO: 94925
  misc_feature 1..158: note = chr6:156817422-156817580
  misc_feature 1..158: note = Hypo
  source 1..158: mol_type = genomic DNA

SEQ ID NO: 126591 - DNA, 30 bp, Homo sapiens; identical to SEQ ID NO: 94926
  misc_feature 1..30: note = chr6:157040065-157040095
  misc_feature 1..30: note = Hypo
  source 1..30: mol_type = genomic DNA

SEQ ID NO: 126592 - DNA, 179 bp, Homo sapiens; identical to SEQ ID NO: 94927
  misc_feature 1..179: note = chr6:157103443-157103622
  misc_feature 1..179: note = Hyper
  source 1..179: mol_type = genomic DNA

SEQ ID NO: 126593 - DNA, 30 bp, Homo sapiens; identical to SEQ ID NO: 94928
  misc_feature 1..30: note = chr6:157255695-157255725
  misc_feature 1..30: note = Hypo
  source 1..30: mol_type = genomic DNA

SEQ ID NO: 126594 - DNA, 30 bp, Homo sapiens; identical to SEQ ID NO: 40915
  misc_feature 1..30: note = chr6:157283403-157283433
  misc_feature 1..30: note = Hypo
  source 1..30: mol_type = genomic DNA

SEQ ID NO: 126595 - DNA, 30 bp, Homo sapiens; identical to SEQ ID NO: 94930
  misc_feature 1..30: note = chr6:157301697-157301727
  misc_feature 1..30: note = Hypo
  source 1..30: mol_type = genomic DNA

SEQ ID NO: 126596 - DNA, 30 bp, Homo sapiens; identical to SEQ ID NO: 94931
  misc_feature 1..30: note = chr6:157431645-157431675
  misc_feature 1..30: note = Hypo
  source 1..30: mol_type = genomic DNA

SEQ ID NO: 126597 - DNA, 30 bp, Homo sapiens; identical to SEQ ID NO: 40916
  misc_feature 1..30: note = chr6:157455406-157455436
  misc_feature 1..30: note = Hypo
  source 1..30: mol_type = genomic DNA

SEQ ID NO: 126598 - DNA, 193 bp, Homo sapiens; identical to SEQ ID NO: 94933
  misc_feature 1..193: note = chr6:157478285-157478478
  misc_feature 1..193: note = Hypo
  source 1..193: mol_type = genomic DNA

SEQ ID NO: 126599 - DNA, 30 bp, Homo sapiens; identical to SEQ ID NO: 94934
  misc_feature 1..30: note = chr6:157502438-157502468
  misc_feature 1..30: note = Hypo
  source 1..30: mol_type = genomic DNA

SEQ ID NO: 126600 - DNA, 48 bp, Homo sapiens; identical to SEQ ID NO: 40918
  misc_feature 1..48: note = chr6:157505817-157505865
  misc_feature 1..48: note = Hypo
  source 1..48: mol_type = genomic DNA

SEQ ID NO: 126601 - DNA, 30 bp, Homo sapiens; identical to SEQ ID NO: 94936
  misc_feature 1..30: note = chr6:157506082-157506112
  misc_feature 1..30: note = Hypo
  source 1..30: mol_type = genomic DNA

SEQ ID NO: 126602 - DNA, 1110 bp, Homo sapiens
  misc_feature 1..1110: note = chr6:157556754-157557864
  misc_feature 1..1110: note = Hyper
  source 1..1110: mol_type = genomic DNA
aaccatttctaaaagcattcctcagcgcttggaacttgcgagctgatggcttttggtggagcccaggaggggcgctgtggggcacagacgtgtgcggggccggcagctgcggagagagcagcgcaccccagccttcaattccccgccgaagatgggactctgcccagagccgaggcccctggctgctgccccgctcccttgcggccgcagtgacactcagagccagattcctcagacaatcttcactcctccgtggtggctgccttgggaggcgttgcggggtgaaggaagtcgcagctggtcccaagcagtggggagggcaggacagggagtaagacaccgccttcctggggtgcacacggaggaggggcgctgcccaggagcggaggggaggggagcggagcgcggagaggagaccggtgccagacttcacccgcctagctctcggaacccccgggggccgcgctcggctccgcctgggggctaccggttctgggccaggagaagaagtggcatccgcggggcagggcgggcggtgacggccggctcaggtggcggccccaccccagcgcccttcagcaggcctgggtcggtcggcctcggaccccgtaggcgccggcggagctggcggcagggacccgacagctctgccgcggactccgcaggggacatcccccaccctggcggcccacccaggcggagcgcggcggggaccgtgcatctagcgcgccctggtgacctgcgggccgaggcgggctgtggggcttggccccgcgactcagccttccgggcccacagcggccctgacccgggaagtgcggaggtttggccgccttcaacagcacctgccaggccactgggagcagcgggggagaagtgggctcgcacaccgacggcctcccgggttcggcggggacgacccgagctaggagcccgcgggggccgtgggagctgctccgccgaggtggacccggggcgcccgcacccctcaccttctttccgtggggtccggggccagggacgcagcgggggacggcgggcatcagccgggcagcgcccgagccgtccctggccgggtccccacacctgcgtgctcgggcatccccaggg

SEQ ID NO: 126603 - DNA, 31 bp, Homo sapiens; identical to SEQ ID NO: 94938
  misc_feature 1..31: note = chr6:157637384-157637415
  misc_feature 1..31: note = Hypo
  source 1..31: mol_type = genomic DNA

SEQ ID NO: 126604 - DNA, 84 bp, Homo sapiens; identical to SEQ ID NO: 40920
  misc_feature 1..84: note = chr6:157638362-157638446
  misc_feature 1..84: note = Hypo
  source 1..84: mol_type = genomic DNA

SEQ ID NO: 126605 - DNA, 256 bp, Homo sapiens; identical to SEQ ID NO: 94940
  misc_feature 1..256: note = chr6:157912932-157913188
  misc_feature 1..256: note = Hypo
  source 1..256: mol_type = genomic DNA

SEQ ID NO: 126606 - DNA, 38 bp, Homo sapiens; identical to SEQ ID NO: 94942
  misc_feature 1..38: note = chr6:158072190-158072228
  misc_feature 1..38: note = Hypo
  source 1..38: mol_type = genomic DNA

SEQ ID NO: 126607 - DNA, 307 bp, Homo sapiens; identical to SEQ ID NO: 94943
  misc_feature 1..307: note = chr6:158093775-158094082
  misc_feature 1..307: note = Hypo
  source 1..307: mol_type = genomic DNA

SEQ ID NO: 126608 - DNA, 30 bp, Homo sapiens; identical to SEQ ID NO: 14891
  misc_feature 1..30: note = chr6:158119028-158119058
  misc_feature 1..30: note = Hypo
  source 1..30: mol_type = genomic DNA

SEQ ID NO: 126609 - DNA, 30 bp, Homo sapiens; identical to SEQ ID NO: 94945
  misc_feature 1..30: note = chr6:158245801-158245831
  misc_feature 1..30: note = Hypo
  source 1..30: mol_type = genomic DNA

SEQ ID NO: 126610 - DNA, 154 bp, Homo sapiens; identical to SEQ ID NO: 94946
  misc_feature 1..154: note = chr6:158430536-158430690
  misc_feature 1..154: note = Hyper
  source 1..154: mol_type = genomic DNA

SEQ ID NO: 126611 - DNA, 184 bp, Homo sapiens; identical to SEQ ID NO: 40924
  misc_feature 1..184: note = chr6:158489608-158489792
  misc_feature 1..184: note = Hypo
  source 1..184: mol_type = genomic DNA

SEQ ID NO: 126612 - DNA, 30 bp, Homo sapiens; identical to SEQ ID NO: 94949
  misc_feature 1..30: note = chr6:158937301-158937331
  misc_feature 1..30: note = Hyper
  source 1..30: mol_type = genomic DNA

SEQ ID NO: 126613 - DNA, 35 bp, Homo sapiens; identical to SEQ ID NO: 94950
  misc_feature 1..35: note = chr6:158957282-158957317
  misc_feature 1..35: note = Hyper
  source 1..35: mol_type = genomic DNA

SEQ ID NO: 126614 - DNA, 241 bp, Homo sapiens; identical to SEQ ID NO: 94951
  misc_feature 1..241: note = chr6:158957747-158957988
  misc_feature 1..241: note = Hyper
  source 1..241: mol_type = genomic DNA

SEQ ID NO: 126615 - DNA, 489 bp, Homo sapiens; identical to SEQ ID NO: 94952
  misc_feature 1..489: note = chr6:158958194-158958683
  misc_feature 1..489: note = Hyper
  source 1..489: mol_type = genomic DNA

SEQ ID NO: 126616 - DNA, 30 bp, Homo sapiens; identical to SEQ ID NO: 40925
  misc_feature 1..30: note = chr6:158978998-158979028
  misc_feature 1..30: note = Hypo
  source 1..30: mol_type = genomic DNA

SEQ ID NO: 126617 - DNA, 79 bp, Homo sapiens; identical to SEQ ID NO: 94954
  misc_feature 1..79: note = chr6:158982731-158982810
  misc_feature 1..79: note = Hypo
  source 1..79: mol_type = genomic DNA

SEQ ID NO: 126618 - DNA, 138 bp, Homo sapiens; identical to SEQ ID NO: 94955
  misc_feature 1..138: note = chr6:159049745-159049883
  misc_feature 1..138: note = Hypo
  source 1..138: mol_type = genomic DNA

SEQ ID NO: 126619 - DNA, 21 bp, Homo sapiens
  misc_feature 1..21: note = chr6:159081339-159081360
  misc_feature 1..21: note = Hypo
  source 1..21: mol_type = genomic DNA
gaacagcgcctggggtgttca

SEQ ID NO: 126620 - DNA, 30 bp, Homo sapiens; identical to SEQ ID NO: 40928
  misc_feature 1..30: note = chr6:159113607-159113637
  misc_feature 1..30: note = Hypo
  source 1..30: mol_type = genomic DNA

SEQ ID NO: 126621 - DNA, 22 bp, Homo sapiens
  misc_feature 1..22: note = chr6:159151570-159151592
  misc_feature 1..22: note = Hypo
  source 1..22: mol_type = genomic DNA
ggcgccccactgcctcgttgcg

SEQ ID NO: 126622 - DNA, 21 bp, Homo sapiens
  misc_feature 1..21: note = chr6:159151652-159151673
  misc_feature 1..21: note = Hypo
  source 1..21: mol_type = genomic DNA
gcaacgcggaaagaaagcagc

SEQ ID NO: 126623 - DNA, 35 bp, Homo sapiens; identical to SEQ ID NO: 94960
  misc_feature 1..35: note = chr6:159151892-159151927
  misc_feature 1..35: note = Hypo
  source 1..35: mol_type = genomic DNA

SEQ ID NO: 126624 - DNA, 50 bp, Homo sapiens; identical to SEQ ID NO: 94961
  misc_feature 1..50: note = chr6:159194739-159194789
  misc_feature 1..50: note = Hypo
  source 1..50: mol_type = genomic DNA

SEQ ID NO: 126625 - DNA, 30 bp, Homo sapiens; identical to SEQ ID NO: 94962
  misc_feature 1..30: note = chr6:159195237-159195267
  misc_feature 1..30: note = Hypo
  source 1..30: mol_type = genomic DNA

SEQ ID NO: 126626 - DNA, 30 bp, Homo sapiens; identical to SEQ ID NO: 94963
  misc_feature 1..30: note = chr6:159228054-159228084
  misc_feature 1..30: note = Hypo
  source 1..30: mol_type = genomic DNA

SEQ ID NO: 126627 - DNA, 265 bp, Homo sapiens; identical to SEQ ID NO: 94964
  misc_feature 1..265: note = chr6:159252784-159253049
  misc_feature 1..265: note = Hypo
  source 1..265: mol_type = genomic DNA

SEQ ID NO: 126628 - DNA, 39 bp, Homo sapiens; identical to SEQ ID NO: 94965
  misc_feature 1..39: note = chr6:159270065-159270104
  misc_feature 1..39: note = Hypo
  source 1..39: mol_type = genomic DNA

SEQ ID NO: 126629 - DNA, 36 bp, Homo sapiens; identical to SEQ ID NO: 94966
  misc_feature 1..36: note = chr6:159343088-159343124
  misc_feature 1..36: note = Hypo
  source 1..36: mol_type = genomic DNA

SEQ ID NO: 126630 - DNA, 46 bp, Homo sapiens; identical to SEQ ID NO: 94967
  misc_feature 1..46: note = chr6:159456944-159456990
  misc_feature 1..46: note = Hypo
  source 1..46: mol_type = genomic DNA

SEQ ID NO: 126631 - DNA, 18 bp, Homo sapiens
  misc_feature 1..18: note = chr6:159537157-159537175
  misc_feature 1..18: note = Hypo
  source 1..18: mol_type = genomic DNA
agtctggctgctgggcgg

SEQ ID NO: 126632 - DNA, 49 bp, Homo sapiens; identical to SEQ ID NO: 94969
  misc_feature 1..49: note = chr6:159551945-159551994
  misc_feature 1..49: note = Hypo
  source 1..49: mol_type = genomic DNA

SEQ ID NO: 126633 - DNA, 164 bp, Homo sapiens; identical to SEQ ID NO: 94970
  misc_feature 1..164: note = chr6:159569246-159569410
  misc_feature 1..164: note = Hypo
  source 1..164: mol_type = genomic DNA

SEQ ID NO: 126634 - DNA, 1367 bp, Homo sapiens
  misc_feature 1..1367: note = chr6:159589910-159591277
  misc_feature 1..1367: note = Hyper
  source 1..1367: mol_type = genomic DNA
aactgggttccttttcgacccgcatcgtgcgcgccctagaaatgacagccagacggagcagggtctaaggacgctgaaaacccctgacgtgggcgcgccgggtgcgggtagggacgtggaaggactgggctagccacaggaactacagcgctgcggaccgggtgaggggtcccggcccgagtccccacttggggcgcagaggtgtttctgtaaggggacaaagggcactcctcggcgcgatgggcgacttccccagccagaaaatgagagggttagacgaggggaggaacttcctcagccacttggcccggcacagcgaccgccccaagttcagaaccgctaagtcagtccggggcgctccggccccttcgtcccgcgccccgcccgcctccagcccgggccccgccgcccccgtcgcccctgtcgcccgggtcgcccccgccggccctggccccggccccgcacaccggcagggggcgcccgagcgcagctaaaaggctcggcgggaggtcggcggcctcagtggcggagcgcggctgccggtgtgcggccgggagcgatcgccgcggggcaggggcgcggcgggcaccgcgcagagcgcgcagaacagacggacggcggcggggacccgacggcggcgcctcggcactccccagactccggccagcgcccccctgccagccgcaagcacccagccccggcccaccccgggctctcgatggcccccgaggccggggcgaccctgcgcgcgccgcgccggctgtcctgggcggcgctgctgctcttggccgcgctgctccccgtcgcctcctcggcggcggcctcaggtacgcgccgcgcccgggcccccggcgctcctcagctccccgcgcaccctcctgcgctcgggccccgtcgtcccgctcagtgctggctacgggtcgtgtcactagcctgtgcgtcctcgtcactcgcgggtcggggcacttggcgccctgtgtgggtggcgggagcggggacgcctcggtgcccggggaccgcagcgcgctggcgtttaactttgccgtcgcccgccttggagtcgggaggctccagccgtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgctccagaggagaagcgctccagtgccagc

SEQ ID NO: 126635 - DNA, 30 bp, Homo sapiens; identical to SEQ ID NO: 94974
  misc_feature 1..30: note = chr6:159653218-159653248
  misc_feature 1..30: note = Hypo
  source 1..30: mol_type = genomic DNA

SEQ ID NO: 126636 - DNA, 106 bp, Homo sapiens; identical to SEQ ID NO: 30908
  misc_feature 1..106: note = chr6:159654897-159655003
  misc_feature 1..106: note = Hyper
  source 1..106: mol_type = genomic DNA

SEQ ID NO: 126637 - DNA, 30 bp, Homo sapiens; identical to SEQ ID NO: 94976
  misc_feature 1..30: note = chr6:159660826-159660856
  misc_feature 1..30: note = Hypo
  source 1..30: mol_type = genomic DNA

SEQ ID NO: 126638 - DNA, 30 bp, Homo sapiens; identical to SEQ ID NO: 94977
  misc_feature 1..30: note = chr6:159925862-159925892
  misc_feature 1..30: note = Hypo
  source 1..30: mol_type = genomic DNA

SEQ ID NO: 126639 - DNA, 58 bp, Homo sapiens; identical to SEQ ID NO: 94978
  misc_feature 1..58: note = chr6:160248421-160248479
  misc_feature 1..58: note = Hypo
  source 1..58: mol_type = genomic DNA

SEQ ID NO: 126640 - DNA, 30 bp, Homo sapiens; identical to SEQ ID NO: 30909
  misc_feature 1..30: note = chr6:160402852-160402882
  misc_feature 1..30: note = Hyper
  source 1..30: mol_type = genomic DNA

SEQ ID NO: 126641 - DNA, 61 bp, Homo sapiens; identical to SEQ ID NO: 94980
  misc_feature 1..61: note = chr6:160450704-160450765
  misc_feature 1..61: note = Hypo
  source 1..61: mol_type = genomic DNA

SEQ ID NO: 126642 - DNA, 30 bp, Homo sapiens; identical to SEQ ID NO: 94981
  misc_feature 1..30: note = chr6:160476041-160476071
  misc_feature 1..30: note = Hypo
  source 1..30: mol_type = genomic DNA

SEQ ID NO: 126643 - DNA, 310 bp, Homo sapiens; identical to SEQ ID NO: 94983
  misc_feature 1..310: note = chr6:160511899-160512209
  misc_feature 1..310: note = Hypo
  source 1..310: mol_type = genomic DNA

SEQ ID NO: 126644 - DNA, 634 bp, Homo sapiens
  misc_feature 1..634: note = chr6:160769301-160769935
  misc_feature 1..634: note = Hyper
  source 1..634: mol_type = genomic DNA
ggggggcaggaggagcggctgcggccggcacagcgccagggcgagtgaggcgggtggcgcgggggaggcggcggagtaaagagaggccgccggctgggtccgcgggtcactccgaggcgcgggctgcgggcggcgggcggcgggcgcaccatgccctccttcgacgaggcgctgcagcgggtgggcgagttcgggcgcttccagaggcgcgtgtttttgctgctgtgcctgacgggcgtcaccttcgccttcctcttcgtcggcgtggtcttcctgggcacgcagcccgaccactactggtgccgcgggccaagtgccgcggcgctggccgagcgctgcggctggagcccggaggaggagtggaaccgcacggcgcccgcctcccgcggcccagagccccccgagcgccgcggccgctgccagcgctacctcctggaggcggccaacgacagcgcctccgccactagcgctctcagctgcgcggacccactcgccgccttccccaaccgctcggctccccttgtgccgtgccgcggcggctggcgctacgcccaggcccactccaccatcgtcagcgaggtaagggcgccccggccctttggaagccggcgggagaggacgatgctggctccca

SEQ ID NO: 126645 - DNA, 61 bp, Homo sapiens; identical to SEQ ID NO: 94986
  misc_feature 1..61: note = chr6:160770239-160770300
  misc_feature 1..61: note = Hyper
  source 1..61: mol_type = genomic DNA

SEQ ID NO: 126646 - DNA, 30 bp, Homo sapiens
  misc_feature 1..30: note = chr6:161100496-161100526
  misc_feature 1..30: note = Hyper
  source 1..30: mol_type = genomic DNA
ccactactaccacctcgtattttgcagcct

SEQ ID NO: 126647 - DNA, 376 bp, Homo sapiens
  misc_feature 1..376: note = chr6:161188236-161188612
  misc_feature 1..376: note = Hyper
  source 1..376: mol_type = genomic DNA
gcctcgtccacccctcgtccacccctccgcctcccgccccggcaccacgccgcgcccgcgtccccgcccagtgcccgcgcctttgcgggccccggtcctgcggggcccctcgcgcactccagaagcatcagtatcctccgggcggccacgggccagctgcggctcccaccctggcgaccctggattgctctccccattctcagcctcaccccccactccttccaccccatattttgccgcctcgaaggacatgaaccatctgctggctgaaggcgcttggacctgaaaccagcgacaggttttggcagctgcacgctcactcccagggaggcgagggcgcccggcgaagtgtggggtctgccgccccctgccggct

SEQ ID NO: 126648 - DNA, 42 bp, Homo sapiens; identical to SEQ ID NO: 94991
  misc_feature 1..42: note = chr6:161259532-161259574
  misc_feature 1..42: note = Hypo
  source 1..42: mol_type = genomic DNA

SEQ ID NO: 126649 - DNA, 512 bp, Homo sapiens
  misc_feature 1..512: note = chr6:161351859-161352371
  misc_feature 1..512: note = Hyper
  source 1..512: mol_type = genomic DNA
gcgtggaagcagaagcgaacgtcacccaggccggcagggggcggcacaccccacacttcgctgcgcgccctcgcctccttgggagggagtgtccagctcccaaaacctgtcgtgggttttgtcccaagtgacttcagccagcagatggttcaagtcctgaggctgcaaaattcggggtggaaggagtggggcgtaaggctgagagtggggagagcaatccaggggcgccagggtgggagccgcagcgggcccgcggccgcccggaggacactgatgcttctggagctcgcgaagggtcccccgcgggagaggaacaaggccgcttgcgctccgcagaggcgcaggcacggggctggggcccggggcgggggcgcgggtgggcggacccctcccgcaagcccatgatggccaggccaaggccgctgggaaaggcaggacgctcgcccatgcgctgccagctgggcttttctccttcgcccgccctgtgttccagggcgcgaccccgttcggtc

SEQ ID NO: 126650 - DNA, 30 bp, Homo sapiens; identical to SEQ ID NO: 94999
  misc_feature 1..30: note = chr6:161560023-161560053
  misc_feature 1..30: note = Hypo
  source 1..30: mol_type = genomic DNA

SEQ ID NO: 126651 - DNA, 121 bp, Homo sapiens; identical to SEQ ID NO: 95000
  misc_feature 1..121: note = chr6:161561655-161561776
  misc_feature 1..121: note = Hypo
  source 1..121: mol_type = genomic DNA

SEQ ID NO: 126652 - DNA, 30 bp, Homo sapiens; identical to SEQ ID NO: 95001
  misc_feature 1..30: note = chr6:161575883-161575913
  misc_feature 1..30: note = Hypo
  source 1..30: mol_type = genomic DNA

SEQ ID NO: 126653 - DNA, 30 bp, Homo sapiens; identical to SEQ ID NO: 95002
  misc_feature 1..30: note = chr6:161585055-161585085
  misc_feature 1..30: note = Hypo
  source 1..30: mol_type = genomic DNA

SEQ ID NO: 126654 - DNA, 188 bp, Homo sapiens; identical to SEQ ID NO: 95003
  misc_feature 1..188: note = chr6:161602138-161602326
  misc_feature 1..188: note = Hypo
  source 1..188: mol_type = genomic DNA

SEQ ID NO: 126655 - DNA, 167 bp, Homo sapiens; identical to SEQ ID NO: 95004
  misc_feature 1..167: note = chr6:161609747-161609914
  misc_feature 1..167: note = Hypo
  source 1..167: mol_type = genomic DNA

SEQ ID NO: 126656 - DNA, 163 bp, Homo sapiens; identical to SEQ ID NO: 95005
  misc_feature 1..163: note = chr6:161619824-161619987
  misc_feature 1..163: note = Hypo
  source 1..163: mol_type = genomic DNA

SEQ ID NO: 126657 - DNA, 186 bp, Homo sapiens; identical to SEQ ID NO: 95006
  misc_feature 1..186: note = chr6:161643685-161643871
  misc_feature 1..186: note = Hypo
  source 1..186: mol_type = genomic DNA

SEQ ID NO: 126658 - DNA, 30 bp, Homo sapiens; identical to SEQ ID NO: 95007
  misc_feature 1..30: note = chr6:161656491-161656521
  misc_feature 1..30: note = Hypo
  source 1..30: mol_type = genomic DNA

SEQ ID NO: 126659 - DNA, 63 bp, Homo sapiens; identical to SEQ ID NO: 40939
  misc_feature 1..63: note = chr6:161672733-161672796
  misc_feature 1..63: note = Hypo
  source 1..63: mol_type = genomic DNA

SEQ ID NO: 126660 - DNA, 175 bp, Homo sapiens; identical to SEQ ID NO: 95009
  misc_feature 1..175: note = chr6:161685567-161685742
  misc_feature 1..175: note = Hypo
  source 1..175: mol_type = genomic DNA

SEQ ID NO: 126661 - DNA, 101 bp, Homo sapiens; identical to SEQ ID NO: 95010
  misc_feature 1..101: note = chr6:161690505-161690606
  misc_feature 1..101: note = Hypo
  source 1..101: mol_type = genomic DNA

SEQ ID NO: 126662 - DNA, 23 bp, Homo sapiens
  misc_feature 1..23: note = chr6:161726250-161726273
  misc_feature 1..23: note = Hypo
  source 1..23: mol_type = genomic DNA
aaaaccagctgaggccgggcgcg

SEQ ID NO: 126663 - DNA, 63 bp, Homo sapiens; identical to SEQ ID NO: 95012
  misc_feature 1..63: note = chr6:161766949-161767012
  misc_feature 1..63: note = Hypo
  source 1..63: mol_type = genomic DNA

SEQ ID NO: 126664 - DNA, 79 bp, Homo sapiens; identical to SEQ ID NO: 40942
  misc_feature 1..79: note = chr6:161780140-161780219
  misc_feature 1..79: note = Hypo
  source 1..79: mol_type = genomic DNA

SEQ ID NO: 126665 - DNA, 25 bp, Homo sapiens
  misc_feature 1..25: note = chr6:161795264-161795289
  misc_feature 1..25: note = Hypo
  source 1..25: mol_type = genomic DNA
tgtgttgtgtatatgcgtatgctgt

SEQ ID NO: 126666 - DNA, 24 bp, Homo sapiens
  misc_feature 1..24: note = chr6:161795349-161795373
  misc_feature 1..24: note = Hypo
  source 1..24: mol_type = genomic DNA
tgtgtgtaacgcatggtgtgcatg

SEQ ID NO: 126667 - DNA, 36 bp, Homo sapiens; identical to SEQ ID NO: 40945
  misc_feature 1..36: note = chr6:161989335-161989371
  misc_feature 1..36: note = Hypo
  source 1..36: mol_type = genomic DNA

SEQ ID NO: 126668 - DNA, 39 bp, Homo sapiens; identical to SEQ ID NO: 95020
  misc_feature 1..39: note = chr6:162084991-162085030
  misc_feature 1..39: note = Hypo
  source 1..39: mol_type = genomic DNA

SEQ ID NO: 126669 - DNA, 30 bp, Homo sapiens; identical to SEQ ID NO: 95021
  misc_feature 1..30: note = chr6:162135996-162136026
  misc_feature 1..30: note = Hypo
  source 1..30: mol_type = genomic DNA

SEQ ID NO: 126670 - DNA, 40 bp, Homo sapiens; identical to SEQ ID NO: 95023
  misc_feature 1..40: note = chr6:162222104-162222144
  misc_feature 1..40: note = Hypo
  source 1..40: mol_type = genomic DNA

SEQ ID NO: 126671 - DNA, 30 bp, Homo sapiens; identical to SEQ ID NO: 95024
  misc_feature 1..30: note = chr6:162226297-162226327
  misc_feature 1..30: note = Hypo
  source 1..30: mol_type = genomic DNA

SEQ ID NO: 126672 - DNA, 17 bp, Homo sapiens
  misc_feature 1..17: note = chr6:162253379-162253396
  misc_feature 1..17: note = Hypo
  source 1..17: mol_type = genomic DNA
gtggggtggctctcacg

SEQ ID NO: 126673 - DNA, 17 bp, Homo sapiens
  misc_feature 1..17: note = chr6:162253696-162253713
  misc_feature 1..17: note = Hypo
  source 1..17: mol_type = genomic DNA
cgcggaactgtaataca

SEQ ID NO: 126674 - DNA, 177 bp, Homo sapiens; identical to SEQ ID NO: 95027
  misc_feature 1..177: note = chr6:162257854-162258031
  misc_feature 1..177: note = Hypo
  source 1..177: mol_type = genomic DNA

SEQ ID NO: 126675 - DNA, 30 bp, Homo sapiens; identical to SEQ ID NO: 40947
  misc_feature 1..30: note = chr6:162280335-162280365
  misc_feature 1..30: note = Hypo
  source 1..30: mol_type = genomic DNA

SEQ ID NO: 126676 - DNA, 181 bp, Homo sapiens; identical to SEQ ID NO: 95032
  misc_feature 1..181: note = chr6:162863312-162863493
  misc_feature 1..181: note = Hypo
  source 1..181: mol_type = genomic DNA

SEQ ID NO: 126677 - DNA, 23 bp, Homo sapiens
  misc_feature 1..23: note = chr6:162921490-162921513
  misc_feature 1..23: note = Hypo
  source 1..23: mol_type = genomic DNA
actgcgcccggcccaaacagcca

SEQ ID NO: 126678 - DNA, 30 bp, Homo sapiens; identical to SEQ ID NO: 95037
  misc_feature 1..30: note = chr6:163521407-163521437
  misc_feature 1..30: note = Hypo
  source 1..30: mol_type = genomic DNA

SEQ ID NO: 126679 - DNA, 38 bp, Homo sapiens; identical to SEQ ID NO: 95040
  misc_feature 1..38: note = chr6:163616660-163616698
  misc_feature 1..38: note = Hypo
  source 1..38: mol_type = genomic DNA

SEQ ID NO: 126680 - DNA, 95 bp, Homo sapiens; identical to SEQ ID NO: 95041
  misc_feature 1..95: note = chr6:163661684-163661779
  misc_feature 1..95: note = Hypo
  source 1..95: mol_type = genomic DNA

SEQ ID NO: 126681 - DNA, 39 bp, Homo sapiens; identical to SEQ ID NO: 95042
  misc_feature 1..39: note = chr6:163673393-163673432
  misc_feature 1..39: note = Hypo
  source 1..39: mol_type = genomic DNA

SEQ ID NO: 126682 - DNA, 564 bp, Homo sapiens
  misc_feature 1..564: note = chr6:163834265-163834829
  misc_feature 1..564: note = Hyper
  source 1..564: mol_type = genomic DNA
aagacctcttgcctccgtattctttcttcatctgtaaaaatgttgacttctgcttttcagactacgcgcacagcctctttatttcctactgcggcttcattccctcacggaacactgacgccatcgcgaaggaagcatttcgagcacgactgacgctccccttattatttgctaagccgctgcgctcgggtctggctacgatttgctttcagaataacgggaaggtgcaacaagatcgcttccctagaggcgcgtcgcccgcgtggcccggaccccccacgcccgcccgccgccccgtgggtgcgcacgcgtgtccgcgcaggcttcccgcctggcgagtgcaaggctcctctccgccgtgctgctttccagcctctcagcaaatcacgaacaccgaaagaagccacggcggcgacgggaggggcgtcgcgcgtgcttccctcggcgacaaagcgggagccgggcgcgccggccgagggcgcccggcgcagagtcccgcagaggcggacgccgcggcacgcgcctcgaaaagcctcaaactcttatcctcggctctcccgcccc

SEQ ID NO: 126683 - DNA, 48 bp, Homo sapiens; identical to SEQ ID NO: 95047
  misc_feature 1..48: note = chr6:163835083-163835131
  misc_feature 1..48: note = Hyper
  source 1..48: mol_type = genomic DNA

SEQ ID NO: 126684 - DNA, 109 bp, Homo sapiens; identical to SEQ ID NO: 95048
  misc_feature 1..109: note = chr6:163835797-163835906
  misc_feature 1..109: note = Hyper
  source 1..109: mol_type = genomic DNA

SEQ ID NO: 126685 - DNA, 1034 bp, Homo sapiens; identical to SEQ ID NO: 95049
  misc_feature 1..1034: note = chr6:163836197-163837231
  misc_feature 1..1034: note = Hyper
  source 1..1034: mol_type = genomic DNA

SEQ ID NO: 126686 - DNA, 311 bp, Homo sapiens; identical to SEQ ID NO: 95050
  misc_feature 1..311: note = chr6:163837469-163837780
  misc_feature 1..311: note = Hyper
  source 1..311: mol_type = genomic DNA

SEQ ID NO: 126687 - DNA, 30 bp, Homo sapiens; identical to SEQ ID NO: 40949
  misc_feature 1..30: note = chr6:163915349-163915379
  misc_feature 1..30: note = Hypo
  source 1..30: mol_type = genomic DNA

SEQ ID NO: 126688 - DNA, 35 bp, Homo sapiens; identical to SEQ ID NO: 95052
  misc_feature 1..35: note = chr6:163923060-163923095
  misc_feature 1..35: note = Hypo
  source 1..35: mol_type = genomic DNA

SEQ ID NO: 126689 - DNA, 140 bp, Homo sapiens; identical to SEQ ID NO: 95053
  misc_feature 1..140: note = chr6:163945790-163945930
  misc_feature 1..140: note = Hypo
  source 1..140: mol_type = genomic DNA

SEQ ID NO: 126690 - DNA, 158 bp, Homo sapiens; identical to SEQ ID NO: 95054
  misc_feature 1..158: note = chr6:163946670-163946828
  misc_feature 1..158: note = Hypo
  source 1..158: mol_type = genomic DNA

SEQ ID NO: 126691 - DNA, 30 bp, Homo sapiens; identical to SEQ ID NO: 95055
  misc_feature 1..30: note = chr6:163979710-163979740
  misc_feature 1..30: note = Hypo
  source 1..30: mol_type = genomic DNA

SEQ ID NO: 126692 - DNA, 23 bp, Homo sapiens
  misc_feature 1..23: note = chr6:164012441-164012464
  misc_feature 1..23: note = Hypo
  source 1..23: mol_type = genomic DNA
tttttgagttgcagccgaagtct

SEQ ID NO: 126693 - DNA, 150 bp, Homo sapiens; identical to SEQ ID NO: 95057
  misc_feature 1..150: note = chr6:164047494-164047644
  misc_feature 1..150: note = Hypo
  source 1..150: mol_type = genomic DNA

SEQ ID NO: 126694 - DNA, 32 bp, Homo sapiens; identical to SEQ ID NO: 95058
  misc_feature 1..32: note = chr6:164057505-164057537
  misc_feature 1..32: note = Hypo
  source 1..32: mol_type = genomic DNA

SEQ ID NO: 126695 - DNA, 138 bp, Homo sapiens; identical to SEQ ID NO: 95059
  misc_feature 1..138: note = chr6:164064007-164064145
  misc_feature 1..138: note = Hypo
  source 1..138: mol_type = genomic DNA

SEQ ID NO: 126696 - DNA, 22 bp, Homo sapiens
  misc_feature 1..22: note = chr6:164114295-164114317
  misc_feature 1..22: note = Hypo
  source 1..22: mol_type = genomic DNA
ttatttttttgagaccgagtct

SEQ ID NO: 126697 - DNA, 50 bp, Homo sapiens; identical to SEQ ID NO: 95061
  misc_feature 1..50: note = chr6:164118784-164118834
  misc_feature 1..50: note = Hypo
  source 1..50: mol_type = genomic DNA

SEQ ID NO: 126698 - DNA, 30 bp, Homo sapiens; identical to SEQ ID NO: 40955
  misc_feature 1..30: note = chr6:164121841-164121871
  misc_feature 1..30: note = Hypo
  source 1..30: mol_type = genomic DNA

SEQ ID NO: 126699 - DNA, 30 bp, Homo sapiens; identical to SEQ ID NO: 95063
  misc_feature 1..30: note = chr6:164136197-164136227
  misc_feature 1..30: note = Hypo
  source 1..30: mol_type = genomic DNA

SEQ ID NO: 126700 - DNA, 71 bp, Homo sapiens; identical to SEQ ID NO: 95064
  misc_feature 1..71: note = chr6:164143599-164143670
  misc_feature 1..71: note = Hypo
  source 1..71: mol_type = genomic DNA

SEQ ID NO: 126701 - DNA, 160 bp, Homo sapiens; identical to SEQ ID NO: 95065
  misc_feature 1..160: note = chr6:164145352-164145512
  misc_feature 1..160: note = Hypo
  source 1..160: mol_type = genomic DNA

SEQ ID NO: 126702 - DNA, 400 bp, Homo sapiens; identical to SEQ ID NO: 95066
  misc_feature 1..400: note = chr6:164149947-164150347
  misc_feature 1..400: note = Hypo
  source 1..400: mol_type = genomic DNA

SEQ ID NO: 126703 - DNA, 30 bp, Homo sapiens; identical to SEQ ID NO: 95067
  misc_feature 1..30: note = chr6:164164781-164164811
  misc_feature 1..30: note = Hypo
  source 1..30: mol_type = genomic DNA

SEQ ID NO: 126704 - DNA, 92 bp, Homo sapiens; identical to SEQ ID NO: 40959
  misc_feature 1..92: note = chr6:164165801-164165893
  misc_feature 1..92: note = Hypo
  source 1..92: mol_type = genomic DNA

SEQ ID NO: 126705 - DNA, 38 bp, Homo sapiens; identical to SEQ ID NO: 95069
  misc_feature 1..38: note = chr6:164170286-164170324
  misc_feature 1..38: note = Hypo
  source 1..38: mol_type = genomic DNA

SEQ ID NO: 126706 - DNA, 59 bp, Homo sapiens; identical to SEQ ID NO: 95070
  misc_feature 1..59: note = chr6:164173782-164173841
  misc_feature 1..59: note = Hypo
  source 1..59: mol_type = genomic DNA

SEQ ID NO: 126707 - DNA, 155 bp, Homo sapiens; identical to SEQ ID NO: 95071
  misc_feature 1..155: note = chr6:164179641-164179796
  misc_feature 1..155: note = Hypo
  source 1..155: mol_type = genomic DNA

SEQ ID NO: 126708 - DNA, 83 bp, Homo sapiens; identical to SEQ ID NO: 95072
  misc_feature 1..83: note = chr6:164182839-164182922
  misc_feature 1..83: note = Hypo
  source 1..83: mol_type = genomic DNA

SEQ ID NO: 126709 - DNA, 85 bp, Homo sapiens; identical to SEQ ID NO: 95073
  misc_feature 1..85: note = chr6:164183688-164183773
  misc_feature 1..85: note = Hypo
  source 1..85: mol_type = genomic DNA

SEQ ID NO: 126710 - DNA, 22 bp, Homo sapiens
  misc_feature 1..22: note = chr6:164196996-164197018
  misc_feature 1..22: note = Hypo
  source 1..22: mol_type = genomic DNA
ctaaaagcgtcttctgacaaac

SEQ ID NO: 126711 - DNA, 207 bp, Homo sapiens; identical to SEQ ID NO: 95075
  misc_feature 1..207: note = chr6:164209872-164210079
  misc_feature 1..207: note = Hypo
  source 1..207: mol_type = genomic DNA

SEQ ID NO: 126712 - DNA, 133 bp, Homo sapiens; identical to SEQ ID NO: 40964
  misc_feature 1..133: note = chr6:164228294-164228427
  misc_feature 1..133: note = Hypo
  source 1..133: mol_type = genomic DNA

SEQ ID NO: 126713 - DNA, 195 bp, Homo sapiens; identical to SEQ ID NO: 95077
  misc_feature 1..195: note = chr6:164228682-164228877
  misc_feature 1..195: note = Hypo
  source 1..195: mol_type = genomic DNA

SEQ ID NO: 126714 - DNA, 176 bp, Homo sapiens; identical to SEQ ID NO: 95078
  misc_feature 1..176: note = chr6:164241293-164241469
  misc_feature 1..176: note = Hypo
  source 1..176: mol_type = genomic DNA

SEQ ID NO: 126715 - DNA, 30 bp, Homo sapiens; identical to SEQ ID NO: 40967
  misc_feature 1..30: note = chr6:164243378-164243408
  misc_feature 1..30: note = Hypo
  source 1..30: mol_type = genomic DNA

SEQ ID NO: 126716 - DNA, 51 bp, Homo sapiens; identical to SEQ ID NO: 95080
  misc_feature 1..51: note = chr6:164245443-164245494
  misc_feature 1..51: note = Hypo
  source 1..51: mol_type = genomic DNA

SEQ ID NO: 126717 - DNA, 21 bp, Homo sapiens
  misc_feature 1..21: note = chr6:164246122-164246143
  misc_feature 1..21: note = Hypo
  source 1..21: mol_type = genomic DNA
ccgggccgatatggaatttct

SEQ ID NO: 126718 - DNA, 123 bp, Homo sapiens; identical to SEQ ID NO: 95082
  misc_feature 1..123: note = chr6:164255972-164256095
  misc_feature 1..123: note = Hypo
  source 1..123: mol_type = genomic DNA

SEQ ID NO: 126719 - DNA, 68 bp, Homo sapiens; identical to SEQ ID NO: 40969
  misc_feature 1..68: note = chr6:164283216-164283284
  misc_feature 1..68: note = Hypo
  source 1..68: mol_type = genomic DNA

SEQ ID NO: 126720 - DNA, 21 bp, Homo sapiens
  misc_feature 1..21: note = chr6:164284046-164284067
  misc_feature 1..21: note = Hypo
  source 1..21: mol_type = genomic DNA
gaagagaaccagaaccgatgc

SEQ ID NO: 126721 - DNA, 38 bp, Homo sapiens; identical to SEQ ID NO: 95085
  misc_feature 1..38: note = chr6:164284509-164284547
  misc_feature 1..38: note = Hypo
  source 1..38: mol_type = genomic DNA

SEQ ID NO: 126722 - DNA, 171 bp, Homo sapiens; identical to SEQ ID NO: 95086
  misc_feature 1..171: note = chr6:164288079-164288250
  misc_feature 1..171: note = Hypo
  source 1..171: mol_type = genomic DNA

SEQ ID NO: 126723 - DNA, 76 bp, Homo sapiens; identical to SEQ ID NO: 95087
  misc_feature 1..76: note = chr6:164314367-164314443
  misc_feature 1..76: note = Hypo
  source 1..76: mol_type = genomic DNA

SEQ ID NO: 126724 - DNA, 461 bp, Homo sapiens; identical to SEQ ID NO: 95088
  misc_feature 1..461: note = chr6:164322314-164322775
  misc_feature 1..461: note = Hypo
  source 1..461: mol_type = genomic DNA

SEQ ID NO: 126725 - DNA, 86 bp, Homo sapiens; identical to SEQ ID NO: 40973
  misc_feature 1..86: note = chr6:164323845-164323931
  misc_feature 1..86: note = Hypo
  source 1..86: mol_type = genomic DNA

SEQ ID NO: 126726 - DNA, 33 bp, Homo sapiens; identical to SEQ ID NO: 95090
  misc_feature 1..33: note = chr6:164329998-164330031
  misc_feature 1..33: note = Hypo
  source 1..33: mol_type = genomic DNA

SEQ ID NO: 126727 - DNA, 108 bp, Homo sapiens; identical to SEQ ID NO: 40974
  misc_feature 1..108: note = chr6:164334224-164334332
  misc_feature 1..108: note = Hypo
  source 1..108: mol_type = genomic DNA

SEQ ID NO: 126728 - DNA, 30 bp, Homo sapiens; identical to SEQ ID NO: 95092
  misc_feature 1..30: note = chr6:164340153-164340183
  misc_feature 1..30: note = Hypo
  source 1..30: mol_type = genomic DNA

SEQ ID NO: 126729 - DNA, 30 bp, Homo sapiens; identical to SEQ ID NO: 95093
  misc_feature 1..30: note = chr6:164344488-164344518
  misc_feature 1..30: note = Hypo
  source 1..30: mol_type = genomic DNA

SEQ ID NO: 126730 - DNA, 181 bp, Homo sapiens; identical to SEQ ID NO: 95094
  misc_feature 1..181: note = chr6:164384580-164384761
  misc_feature 1..181: note = Hypo
  source 1..181: mol_type = genomic DNA

SEQ ID NO: 126731 - DNA, 65 bp, Homo sapiens; identical to SEQ ID NO: 95095
  misc_feature 1..65: note = chr6:164410701-164410766
  misc_feature 1..65: note = Hypo
  source 1..65: mol_type = genomic DNA

SEQ ID NO: 126732 - DNA, 30 bp, Homo sapiens; identical to SEQ ID NO: 95096
  misc_feature 1..30: note = chr6:164441343-164441373
  misc_feature 1..30: note = Hypo
  source 1..30: mol_type = genomic DNA

SEQ ID NO: 126733 - DNA, 184 bp, Homo sapiens; identical to SEQ ID NO: 95098
  misc_feature 1..184: note = chr6:164500295-164500479
  misc_feature 1..184: note = Hypo
  source 1..184: mol_type = genomic DNA

SEQ ID NO: 126734 - DNA, 115 bp, Homo sapiens
  misc_feature 1..115: note = chr6:164520779-164520894
  misc_feature 1..115: note = Hypo
  source 1..115: mol_type = genomic DNA
cgctggggcagatctcgccgcagggcagcaggcggtgctggtccagatactctggggagtctgcgcggtgtgcccggagcccctgggcgaacacggggcacgttgctgagaagca

SEQ ID NO: 126735 - DNA, 60 bp, Homo sapiens; identical to SEQ ID NO: 95099
  misc_feature 1..60: note = chr6:164565819-164565879
  misc_feature 1..60: note = Hypo
  source 1..60: mol_type = genomic DNA

SEQ ID NO: 126736 - DNA, 49 bp, Homo sapiens; identical to SEQ ID NO: 95100
  misc_feature 1..49: note = chr6:164637238-164637287
  misc_feature 1..49: note = Hypo
  source 1..49: mol_type = genomic DNA

SEQ ID NO: 126737 - DNA, 30 bp, Homo sapiens; identical to SEQ ID NO: 95101
  misc_feature 1..30: note = chr6:165416380-165416410
  misc_feature 1..30: note = Hypo
  source 1..30: mol_type = genomic DNA

SEQ ID NO: 126738 - DNA, 61 bp, Homo sapiens; identical to SEQ ID NO: 95102
  misc_feature 1..61: note = chr6:165731354-165731415
  misc_feature 1..61: note = Hypo
  source 1..61: mol_type = genomic DNA

SEQ ID NO: 126739 - DNA, 30 bp, Homo sapiens; identical to SEQ ID NO: 95103
  misc_feature 1..30: note = chr6:165746822-165746852
  misc_feature 1..30: note = Hypo
  source 1..30: mol_type = genomic DNA

SEQ ID NO: 126740 - DNA, 198 bp, Homo sapiens; identical to SEQ ID NO: 95105
  misc_feature 1..198: note = chr6:166050958-166051156
  misc_feature 1..198: note = Hypo
  source 1..198: mol_type = genomic DNA

SEQ ID NO: 126741 - DNA, 1514 bp, Homo sapiens
  misc_feature 1..1514: note = chr6:166074010-166075524
  misc_feature 1..1514: note = Hyper
  source 1..1514: mol_type = genomic DNA
cggggttgcaaggagcggccgatcccggcgcgaatacgctcgccagcccgggggctgcaccccaaaggtgcctgagcgggcggtgagcccggagcagcttcggccgcagggaggggctcaacctcgggtgccctggagacccgggtcggccaaagcctgggaatgagccgcagttgggagcgggaaaccgaaacagcaatcctggaagagcgtcggcccagagaaggcgccgcggaaacgcggctcctgagcgaggcgcagacaaaggctcgggtgcacacgcggtggacggtggctccggagccgcgctctgggccgcgggaagccgcacccgccccgactggcgccggagtcgggcgggggcccatgggcgcgacctcctgcacccggaggtgctcctacccggccccgccgcggtcttcccgtcctcaccctgctccccctccatccgcgaccgcgacgcccccctcctctgcgcaccgggcgcctcctctttcctcactgtctcccgcctgcctgcttccttctagcgaacccctgccttgacttttctgctcaatcttgtcccccacccccgtgacatgcctttctgccacctctgcctcagcgcgctctcggccccgcgcccgcgggtggcgaggaggagtggccacgccacagtgggcccgggggcgcatcctgcgagtcggaggcggcggcgcctttctcttccaccctagcgacctattgtccttcccttttctctaccaccccggaccccagagaagcccgggaccaacaggacgcggcccggggtgggggtgcgtcccctgggtggaggtgcaaccgtttccaccccgccagtccatgctctggatgccggtcactgcgcggggtgggaggccgggcgcccactccgagtcctggagaacggcggtgccatcacagttggaagcgcggggttctgaggccctggcctccctcaccccggctacagggacccggtgggctggacccccaagtggaaggaagcgcatctgctccagccaagtggccacaggctcaagagggaggaacctaagtggtcacaaagttgagtataaatacgcgccggacaagtgtggccagaaacggcacgaggggcggagaaggaggcggcaggtcccgctcgcaacgtccaagctcccgccgccctcccgagccgcccttcccccgagcgctcgcggagcctgggaaaccccggcgtccctgcgcggccgaacgctcccgcgctccgccaggggcaccggctcctgcccctccagagaagccccctgggcgctccacgcccgggcacgggcacctcgctcgacacccgcttcccacccagcaggccaagccccccacctgcccccaggggatgaggagccgccccacctccggggaacggggagcaggccacttactggggctcaggaagcactcggtcagccttcggaagcagctcgcattattagaaggtccatcttccatgtcggagccgaagagcagcgcgg

SEQ ID NO: 126742 - DNA, 964 bp, Homo sapiens; identical to SEQ ID NO: 95108
  misc_feature 1..964: note = chr6:166076095-166077059
  misc_feature 1..964: note = Hyper
  source 1..964: mol_type = genomic DNA

SEQ ID NO: 126743 - DNA, 1101 bp, Homo sapiens
  misc_feature 1..1101: note = chr6:166077335-166078436
  misc_feature 1..1101: note = Hyper
  source 1..1101: mol_type = genomic DNA
acccccacccccttccgtagccatgaatccaggcagttgccactgaagggaaatgagccgcccaatgggcgctcagaactaggagccgccagaagtttggggaagttggagcgcaagagcgcacacagatgcacaggtgtccgcgttcgggcaggcacgcgcggcggggccaccatggcgcgctgggtccgaggaggggcggtggctgtgctgttccacggtggcacgggctgtccggactgcctggacgaggtcaccttccccggagtggagcacacgcgccaaagctcagctttcacgaagggcaaaacggtcacccaagcgccaggcgtgcgctacagtgcagcaactgggttgacccagggccctgggctcccggtgtgccccgggtcccggggccatttctcgccctccacgttttcttctttctatccagtttcacatgtttattttgaagcgtgctccagattcctcactagtcgatgctttccccgactcccatccaaactccccccaatggaaaataacacttttgtatttgcaccaagctgagcagttgggatgcaaaggacatgctggggctcccctcccccagtaaagtccacagacgtctccgcgattgccgggcagattctgagtgtcgcgtgtaacgggcatcagacttggcactcactaggtcagaatccctacatttgtggaagaagaaaatgattcctgtgactcttaccttaggggcgctgcccttgtttctgaattttttcggcaaagaaaaaaactgcaatggttgagccaggctgccggcagcctcccggcttgacgcttctccagccgtgcagagtccactccggttactttgctgcgagtccggagtttgtgctttcgcgactggaccaggcagcaagggtctgagggctgcccacacatttagggaagtcgagtttctcctcaagtgtttattgtttattcctttacacgcaaaattgtttctccttgtcatttaagtttctttatttgcattttggagttactaaatctatttttcagttccaagaaaatatacatttaacttgcccataagcccccttgcgggcgcaggagaca

SEQ ID NO: 126744 - DNA, 33 bp, Homo sapiens; identical to SEQ ID NO: 95111
  misc_feature 1..33: note = chr6:166122198-166122231
  misc_feature 1..33: note = Hypo
  source 1..33: mol_type = genomic DNA

SEQ ID NO: 126745 - DNA, 47 bp, Homo sapiens; identical to SEQ ID NO: 95112
  misc_feature 1..47: note = chr6:166128567-166128614
  misc_feature 1..47: note = Hypo
  source 1..47: mol_type = genomic DNA

SEQ ID NO: 126746 - DNA, 185 bp, Homo sapiens; identical to SEQ ID NO: 95113
  misc_feature 1..185: note = chr6:166217994-166218179
  misc_feature 1..185: note = Hyper
  source 1..185: mol_type = genomic DNA

SEQ ID NO: 126747 - DNA, 274 bp, Homo sapiens; identical to SEQ ID NO: 95114
  misc_feature 1..274: note = chr6:166218546-166218820
  misc_feature 1..274: note = Hyper
  source 1..274: mol_type = genomic DNA

SEQ ID NO: 126748 - DNA, 648 bp, Homo sapiens
  misc_feature 1..648: note = chr6:166267494-166268142
  misc_feature 1..648: note = Hyper
  source 1..648: mol_type = genomic DNA
gtgggaagccaaggccgtgatgcggggcgtggtggtgagcaggctgcgctggacccagacagacgcgcggggtcctagggaagagcccaggcagggggaagcccgtgggcggtgagaccctcccgtgccacgggcgcagcgcagcgctggctggggccgacggggcgcaccggcggacggtgatgaacccggagacccggcagccaggctgggctgcagcagcctttgcctggacgtcagggtggagcccgggaatcgcccctgcgccgggtgacggaggagaaaggggcccgcaggaggcaggagggagcgcctggcacagggacccagggactcgagcaggtggtccctggggaacggggagtgaggccggaaggagagaaagccaagaccaggtgcgttttggaaattgctgctgtgagccgcaagacgttcgcaggctctgctgcgagcccccaggacgtcccccggtgtccacctccgggcggctctcgcggccagacaaggagccctgaggggcggcctcaaggagcgcccaggccgctgagctcccagggcggcacagagggagcccgggggtccccagctctggcctcgccgtcttgtcttgctggaggtgaggggagcgggtggcgaaggtgcaggagc

SEQ ID NO: 126749 - DNA, 61 bp, Homo sapiens; identical to SEQ ID NO: 95116
  misc_feature 1..61: note = chr6:166298461-166298522
  misc_feature 1..61: note = Hyper
  source 1..61: mol_type = genomic DNA

SEQ ID NO: 126750 - DNA, 156 bp, Homo sapiens; identical to SEQ ID NO: 95117
  misc_feature 1..156: note = chr6:166302038-166302194
  misc_feature 1..156: note = Hypo
  source 1..156: mol_type = genomic DNA

SEQ ID NO: 126751 - DNA, 30 bp, Homo sapiens; identical to SEQ ID NO: 95118
  misc_feature 1..30: note = chr6:166314916-166314946
  misc_feature 1..30: note = Hypo
  source 1..30: mol_type = genomic DNA

SEQ ID NO: 126752 - DNA, 111 bp, Homo sapiens; identical to SEQ ID NO: 95119
  misc_feature 1..111: note = chr6:166343020-166343131
  misc_feature 1..111: note = Hypo
  source 1..111: mol_type = genomic DNA

SEQ ID NO: 126753 - DNA, 30 bp, Homo sapiens; identical to SEQ ID NO: 95120
  misc_feature 1..30: note = chr6:166344391-166344421
  misc_feature 1..30: note = Hypo
  source 1..30: mol_type = genomic DNA

SEQ ID NO: 126754 - DNA, 115 bp, Homo sapiens; identical to SEQ ID NO: 95121
  misc_feature 1..115: note = chr6:166399418-166399533
  misc_feature 1..115: note = Hyper
  source 1..115: mol_type = genomic DNA

SEQ ID NO: 126755 - DNA, 945 bp, Homo sapiens; identical to SEQ ID NO: 95122
  misc_feature 1..945: note = chr6:166400555-166401500
  misc_feature 1..945: note = Hyper
  source 1..945: mol_type = genomic DNA

SEQ ID NO: 126756 - DNA, 793 bp, Homo sapiens
  misc_feature 1..793: note = chr6:166401934-166402727
  misc_feature 1..793: note = Hyper
  source 1..793: mol_type = genomic DNA
ccccaacccgacccccgccccttgtcactacgtgtcgggctcgctctgcctggagggaggctggggtgcggggaagcagggagtgcaaacagacattggttctctttcctcttcccattcatacatttctgttggagtcctagggccgccgcgccgggagtcgcaatgaatggatggatgcccgcgcgctgggaccaccaggtccgcagagatgtcgccggcgctaggggcgctcctcccgcgtggggacaggcgccctcgcctaggcgcagtgtggggggaccccaaaagacccttaagaggccaaaggcctgctctccccgttctccccaacacacaccaggggtcttttctgccccggagaagttgggacgcaaaacgtagggaactgcgctcagtctccgcaccacgaagagtcgagatggggaccgagaccagcacggacggtagcaacagagaggggagcgcccaagtggcgcaacgttgtggctgaagccaagcctgtcgcctccccctgagtaccgctggcggcccaggaccgtgcgctctcccttcctgagcacccagggatgcactgcgcagggaaggagggcacggcgggagggtgcttgcaggggactgctgcgcggattccccatccgcacccggctcgcggggaatccgtgggcttgcactcgccagaaagagctgctgcaggagcagccggatggtgaggcccgttcccgaccctgggtgggaggaacttaaagggctgagttctgaggcgccaggcacagggcgcagcttcataaat

SEQ ID NO: 126757 - DNA, 158 bp, Homo sapiens; identical to SEQ ID NO: 95124
  misc_feature 1..158: note = chr6:166419898-166420056
  misc_feature 1..158: note = Hyper
  source 1..158: mol_type = genomic DNA

SEQ ID NO: 126758 - DNA, 362 bp, Homo sapiens
  misc_feature 1..362: note = chr6:166421919-166422281
  misc_feature 1..362: note = Hyper
  source 1..362: mol_type = genomic DNA
ggagatgcgcccaagcgggggcggaggagcgggtcgcgccgctgacattcgccaaggacaggatggggtgggcgcccgccggtggccgactccgccccgcctctcaggggtgcgagtcatcagcgcagcggcggatcctggcccagggagccaccggcccaccctcgcgcccaggagccggactcggagacgtccacctggtggagagacgcgagggagccatgcagacaggggctgctccgtggagagcccgggaagcctgcggggcgccggaggggtgggtcccgggacagaccagtgaccatccgcctcctgcgtagcgctgcccccaggagaggaaaacccatcggaggttgtgctgt

SEQ ID NO: 126759 - DNA, 42 bp, Homo sapiens; identical to SEQ ID NO: 95127
  misc_feature 1..42: note = chr6:166487228-166487270
  misc_feature 1..42: note = Hypo
  source 1..42: mol_type = genomic DNA

SEQ ID NO: 126760 - DNA, 135 bp, Homo sapiens; identical to SEQ ID NO: 95128
  misc_feature 1..135: note = chr6:166571802-166571937
  misc_feature 1..135: note = Hypo
  source 1..135: mol_type = genomic DNA

SEQ ID NO: 126761 - DNA, 3679 bp, Homo sapiens
  misc_feature 1..3679: note = chr6:166579715-166583394
  misc_feature 1..3679: note = Hyper
  source 1..3679: mol_type = genomic DNA
tttacaagtttgttccgactccacgcagtaagtactgtggcgcatgtttaaatttaaatgcgactttgccatcaaggctgatatcttttccacccccaggagagtttagggctagacaacggaagttccccaaaagctccagtccttcaaaggggagtgctcccgctccccgttcgccaggcgtggatgttatcagcttagtataaacagcgctaaaggccttattagagaaggctgtggcagtttctccagggcagacgtcgcctcccgttcaagcagcgtcccttcccacaacccccgtgcagaaggcgcagcgcggccccctcctcgctggtcccagacctggcgggctcctcacacctacctggccccctccgttgagcttgttggtgagcttgactttgctgaaggagacgggagccttcatccagtgggccccgaagttgggcgagtcggggtggatgtagacgcagctgggcgcctgcggctccggcttgccccccggcacccattccccgttcacgtacttccagcggtggttgtccgccgccacgaagtccagcaggaaggagtacatggcgttggggtccaggccagacacgttcaccttcagcaccggaaacatcctcctggaaaacacggggcgggcgcaggaggaccccgacactgaccaggtaggccggaggcagaagctgggcacagaggcctcagttatttcggggcacagaggagccccctggggaacgtccgagggtgactcccaagctcccccttccccgagccctgccaggtccaggtggcctcctcaccatctccacggcctcgggagggaggggaggagaggacctggcgaagggtttcagtgcaggaggccacatcccgcggggacaggcggggaccagggcgcgcctcgcgggtcccgggatgcctccgaggtcgggacaccgaagtgcgcgttcctcctccccaagcttccgcggagaaagccccagaagaggggcttgtagaaatgcactcgagggagttaaccagagcgggaacaaacacaaagccctcctccaggagaaaaagggttcgacctccgggaacttgccaggtcccccaggctgcccaggcgctggagagcgcggcgcgcgcgggctccggacgcgcacccacctgccgttcttggtcacgatcatctcattggtgagctccttgaagcgcagccacagctcgctctcctccaggcccacgcgcagttcgcgctctgtggggtcgcccttctcgctgcccgcctgcagctcattctccacggcgctcagcaggtggtccactcggtactgcaggctctttcccgcgctctcggtgccaggggagctcatcctcccgtccggctcccctccccgccgtccccgaagcccagactcgctacctgagatccaccttccctgctcttggccgccgcccttccgagaaaaggggccccttggaccgagacctgcgacggctcccgggtcccgggtcccggcacagacccgggaggagggcgcggaccaagacttggggggaggggacgggggcagaggggtggggagaagttattccacttgaactccccaaggctctactagtgtaggtctctggggaccgaaattcagtgccctccccataaatagagccgcggcggcagcgctggggtgctcggcggattgggccgcgcacgctttgaagtgccgggcagcctcccattggccgagagcggccatatcagacccagccgggcgggtctgggaggccgggggccaacaatgggctcccgcacgcctgtttcatgtaaatccggggccccagccctgcgagccccggcccagcccctacacccccgcccttctccaaatgtttgcacctccatcaaagcggcggggcaagccccggaggaaggtaagctggacgccccggcctgccccagcccgccccagcccgccccagcccgcacttccgcgaggggctgcccggcagcctgcgatgctccctgattcccgcgcggggtcctcctcgctttcccagcgcgcccggatcccgcagccgcgccaggctggaacgttcgcgcggcctcacctgtccccgctccaggcgcgcctccctcccctcccagggacgagcgcatttggccgggctttgggatgcgccgcgctcgtctcgccgcagtagtagtgctgttctcgcgcctccgatgcctcaactctccagtctggcagtttccggtgcacctgtccccacacgtccctcgcccacggagccccaggcggcgttacgcacacccaggatcgtggatcagcctgccccggcgtcgggtgtccccgcggctctcaccatctggaaaaggaaggtccgcgcgcagagagggaaatggacggaaataagcaaaagcaaaacaaccccttctgagaagtgtcctcctcgctctcttataaaaacaggacttgttgccgaggtcagcgcgcgcatcgagtgtgccaggcgtgtgcgtggtttctgctgtgtcattgctttcacggaaggtgggagaaggtcggggctggcggggtggtccggactagtgggactcggggcgctttccccgcccggcccagcgccaagcggtgtcggcagcggttgttttattacctttcggtgagaacttacgcgaggagagcgaaggagaggtgacaatgagcaggaaatagttcagtggggtctctttaaacagtaacattcctcctaaaacgggagcccaggaagggggaaggaggcagaagctcccccttccaaggcctggctttgcgcttctgcacacctcgcccattcgctggacgagggcctgcctcgggtagcagcctctgtttcccggtctcctgagcgggcaccccagccccaacccctctagagaaagcctgcgcatcgggtggggcagcgagttcagaggagtcttgcgccctagcaagggggctttcccgcggacatggtatctgcgccccgcgctaagtctcccctgccccctgccccctgcccctcgcccctcgcccagccgggctcgctccggggtcgggaattgctggggaagccgaaggagggatccccgcccgggactcgagggatcgacccgcctcgcggtatgcggagggctgccaggagccagtcccggggaagggtgcctgccgcccgtgggggacagggctccttctctcccttctccaacttacaccgacgagtcaggaagccggagcgtctagtccctgtccgcatttctcagtgtcttttgatgtctgggatgcatggatattcccagggggctgacccgaggtggggaagtttccttctagaaagaggcaccaaaaggacctcatttgctcctgacgccggaccctcctgacacgccttcactggctcatcgggtcctgggctttgggggagagcgtggtgcgtgttactctccttactccgggtattaaaatgtctaagaggtcatcgctttggcccaaggcctcccgaggataagataaaagggaaaagtggaggggaggtgaaggaggaacgagggtgggtcccaggcaattgagggcctcggaaccctaggcacgggagcgaaacctctcctgcggcttcagggcaaaggagtcccgaaggctggatccctcccctgcgctcggacggcgtc

SEQ ID NO: 126762 - DNA, 42 bp, Homo sapiens; identical to SEQ ID NO: 95133
  misc_feature 1..42: note = chr6:166635577-166635619
  misc_feature 1..42: note = Hypo
  source 1..42: mol_type = genomic DNA

SEQ ID NO: 126763 - DNA, 570 bp, Homo sapiens
  misc_feature 1..570: note = chr6:166666726-166667296
  misc_feature 1..570: note = Hyper
  source 1..570: mol_type = genomic DNA
tcgaaaaaaaaagaagaggaaagaaaaagaaaaccagaacgagaaagtgcggccagcccgggctcaggagctgggtgggaaacaaagccgccagaaaatgacaagtaaacacgcagccgcgggaagccactgggcggagcgggcgctaatgagcgcgcagcggggccgccacgcccgcgcggacacggagcagcggcgcctttccctgcgactggctgtgtcgcctggagcccggcggccgccaccccagggagaaagctccggtgaggggagcagacgctgggacccgtggtctcgccctctgctctttcctggctggggacgggggtagctcccaggcaaaggccctccggggtctccgcccggggggccccacctgccttgtgacggctgagatgtgcgcgtcccacccactttccaaggcgcctttgaagtcgtttctcattaaaaaacaagctttttgaataaccaaatgttcctttggcgccctccaattttattttactgtaatctattgagttgtatttgtttttctgaatccgcttcctaggaaagcgccccctcccattt

SEQ ID NO: 126764 - DNA, 66 bp, Homo sapiens; identical to SEQ ID NO: 95137
  misc_feature 1..66: note = chr6:166667524-166667590
  misc_feature 1..66: note = Hyper
  source 1..66: mol_type = genomic DNA

SEQ ID NO: 126765 - DNA, 188 bp, Homo sapiens; identical to SEQ ID NO: 95138
  misc_feature 1..188: note = chr6:166683768-166683956
  misc_feature 1..188: note = Hypo
  source 1..188: mol_type = genomic DNA

SEQ ID NO: 126766 - DNA, 137 bp, Homo sapiens; identical to SEQ ID NO: 95139
  misc_feature 1..137: note = chr6:166711365-166711502
  misc_feature 1..137: note = Hypo
  source 1..137: mol_type = genomic DNA

SEQ ID NO: 126767 - DNA, 278 bp, Homo sapiens; identical to SEQ ID NO: 95140
  misc_feature 1..278: note = chr6:166721166-166721444
  misc_feature 1..278: note = Hyper
  source 1..278: mol_type = genomic DNA

SEQ ID NO: 126768 - DNA, 480 bp, Homo sapiens; identical to SEQ ID NO: 95141
  misc_feature 1..480: note = chr6:166721658-166722138
  misc_feature 1..480: note = Hyper
  source 1..480: mol_type = genomic DNA

SEQ ID NO: 126769 - DNA, 30 bp, Homo sapiens; identical to SEQ ID NO: 95142
  misc_feature 1..30: note = chr6:166731737-166731767
  misc_feature 1..30: note = Hypo
  source 1..30: mol_type = genomic DNA

SEQ ID NO: 126770 - DNA, 30 bp, Homo sapiens; identical to SEQ ID NO: 95143
  misc_feature 1..30: note = chr6:166825908-166825938
  misc_feature 1..30: note = Hypo
  source 1..30: mol_type = genomic DNA

SEQ ID NO: 126771 - DNA, 32 bp, Homo sapiens; identical to SEQ ID NO: 40979
  misc_feature 1..32: note = chr6:166888304-166888336
  misc_feature 1..32: note = Hypo
  source 1..32: mol_type = genomic DNA

SEQ ID NO: 126772 - DNA, 193 bp, Homo sapiens; identical to SEQ ID NO: 95145
  misc_feature 1..193: note = chr6:166891666-166891859
  misc_feature 1..193: note = Hypo
  source 1..193: mol_type = genomic DNA

SEQ ID NO: 126773 - DNA, 238 bp, Homo sapiens; identical to SEQ ID NO: 95146
  misc_feature 1..238: note = chr6:166911041-166911279
  misc_feature 1..238: note = Hypo
  source 1..238: mol_type = genomic DNA

SEQ ID NO: 126774 - DNA, 30 bp, Homo sapiens; identical to SEQ ID NO: 95147
  misc_feature 1..30: note = chr6:166914926-166914956
  misc_feature 1..30: note = Hypo
  source 1..30: mol_type = genomic DNA

SEQ ID NO: 126775 - DNA, 33 bp, Homo sapiens; identical to SEQ ID NO: 95148
  misc_feature 1..33: note = chr6:166939005-166939038
  misc_feature 1..33: note = Hypo
  source 1..33: mol_type = genomic DNA

SEQ ID NO: 126776 - DNA, 30 bp, Homo sapiens; identical to SEQ ID NO: 95149
  misc_feature 1..30: note = chr6:166943962-166943992
  misc_feature 1..30: note = Hypo
  source 1..30: mol_type = genomic DNA

SEQ ID NO: 126777 - DNA, 166 bp, Homo sapiens; identical to SEQ ID NO: 95150
  misc_feature 1..166: note = chr6:166944346-166944512
  misc_feature 1..166: note = Hypo
  source 1..166: mol_type = genomic DNA

SEQ ID NO: 126778 - DNA, 30 bp, Homo sapiens; identical to SEQ ID NO: 95151
  misc_feature 1..30: note = chr6:166946950-166946980
  misc_feature 1..30: note = Hypo
  source 1..30: mol_type = genomic DNA

SEQ ID NO: 126779 - DNA, 30 bp, Homo sapiens; identical to SEQ ID NO: 40982
  misc_feature 1..30: note = chr6:166982961-166982991
  misc_feature 1..30: note = Hypo
  source 1..30: mol_type = genomic DNA

SEQ ID NO: 126780 - DNA, 83 bp, Homo sapiens; identical to SEQ ID NO: 95153
  misc_feature 1..83: note = chr6:167038238-167038321
  misc_feature 1..83: note = Hypo
  source 1..83: mol_type = genomic DNA

SEQ ID NO: 126781 - DNA, 30 bp, Homo sapiens; identical to SEQ ID NO: 95154
  misc_feature 1..30: note = chr6:167039728-167039758
  misc_feature 1..30: note = Hyper
  source 1..30: mol_type = genomic DNA

SEQ ID NO: 126782 - DNA, 198 bp, Homo sapiens; identical to SEQ ID NO: 95155
  misc_feature 1..198: note = chr6:167040127-167040325
  misc_feature 1..198: note = Hyper
  source 1..198: mol_type = genomic DNA

SEQ ID NO: 126783 - DNA, 94 bp, Homo sapiens; identical to SEQ ID NO: 95156
  misc_feature 1..94: note = chr6:167041860-167041954
  misc_feature 1..94: note = Hyper
  source 1..94: mol_type = genomic DNA

SEQ ID NO: 126784 - DNA, 30 bp, Homo sapiens; identical to SEQ ID NO: 95157
  misc_feature 1..30: note = chr6:167045191-167045221
  misc_feature 1..30: note = Hypo
  source 1..30: mol_type = genomic DNA

SEQ ID NO: 126785 - DNA, 124 bp, Homo sapiens; identical to SEQ ID NO: 95158
  misc_feature 1..124: note = chr6:167128131-167128255
  misc_feature 1..124: note = Hypo
  source 1..124: mol_type = genomic DNA

SEQ ID NO: 126786 - DNA, 87 bp, Homo sapiens; identical to SEQ ID NO: 95159
  misc_feature 1..87: note = chr6:167129163-167129250
  misc_feature 1..87: note = Hypo
  source 1..87: mol_type = genomic DNA

SEQ ID NO: 126787 - DNA, 30 bp, Homo sapiens; identical to SEQ ID NO: 95160
  misc_feature 1..30: note = chr6:167130073-167130103
  misc_feature 1..30: note = Hypo
  source 1..30: mol_type = genomic DNA

SEQ ID NO: 126788 - DNA, 102 bp, Homo sapiens; identical to SEQ ID NO: 95161
  misc_feature 1..102: note = chr6:167136306-167136408
  misc_feature 1..102: note = Hypo
  source 1..102: mol_type = genomic DNA

SEQ ID NO: 126789 - DNA, 308 bp, Homo sapiens; identical to SEQ ID NO: 95162
  misc_feature 1..308: note = chr6:167139142-167139450
  misc_feature 1..308: note = Hypo
  source 1..308: mol_type = genomic DNA

SEQ ID NO: 126790 - DNA, 159 bp, Homo sapiens; identical to SEQ ID NO: 40985
  misc_feature 1..159: note = chr6:167140362-167140521
  misc_feature 1..159: note = Hypo
  source 1..159: mol_type = genomic DNA

SEQ ID NO: 126791 - DNA, 42 bp, Homo sapiens; identical to SEQ ID NO: 95164
  misc_feature 1..42: note = chr6:167144433-167144475
  misc_feature 1..42: note = Hypo
  source 1..42: mol_type = genomic DNA

SEQ ID NO: 126792 - DNA, 30 bp, Homo sapiens; identical to SEQ ID NO: 95165
  misc_feature 1..30: note = chr6:167250605-167250635
  misc_feature 1..30: note = Hypo
  source 1..30: mol_type = genomic DNA

SEQ ID NO: 126793 - DNA, 363 bp, Homo sapiens; identical to SEQ ID NO: 95166
  misc_feature 1..363: note = chr6:167275668-167276031
  misc_feature 1..363: note = Hyper
  source 1..363: mol_type = genomic DNA

SEQ ID NO: 126794 - DNA, 272 bp, Homo sapiens; identical to SEQ ID NO: 95167
  misc_feature 1..272: note = chr6:167276309-167276581
  misc_feature 1..272: note = Hyper
  source 1..272: mol_type = genomic DNA

SEQ ID NO: 126795 - DNA, 30 bp, Homo sapiens; identical to SEQ ID NO: 95168
  misc_feature 1..30: note = chr6:167601185-167601215
  misc_feature 1..30: note = Hypo
  source 1..30: mol_type = genomic DNA

SEQ ID NO: 126796 - DNA, 30 bp, Homo sapiens; identical to SEQ ID NO: 95169
  misc_feature 1..30: note = chr6:167753495-167753525
  misc_feature 1..30: note = Hypo
  source 1..30: mol_type = genomic DNA

SEQ ID NO: 126797 - DNA, 194 bp, Homo sapiens; identical to SEQ ID NO: 95170
  misc_feature 1..194: note = chr6:167764951-167765145
  misc_feature 1..194: note = Hyper
  source 1..194: mol_type = genomic DNA

SEQ ID NO: 126798 - DNA, 30 bp, Homo sapiens; identical to SEQ ID NO: 95171
  misc_feature 1..30: note = chr6:167833924-167833954
  misc_feature 1..30: note = Hypo
  source 1..30: mol_type = genomic DNA

SEQ ID NO: 126799 - DNA, 324 bp, Homo sapiens; identical to SEQ ID NO: 95172
  misc_feature 1..324: note = chr6:167835015-167835339
  misc_feature 1..324: note = Hypo
  source 1..324: mol_type = genomic DNA

SEQ ID NO: 126800 - DNA, 71 bp, Homo sapiens; identical to SEQ ID NO: 95173
  misc_feature 1..71: note = chr6:167836558-167836629
  misc_feature 1..71: note = Hypo
  source 1..71: mol_type = genomic DNA

SEQ ID NO: 126801 - DNA, 32 bp, Homo sapiens; identical to SEQ ID NO: 95174
  misc_feature 1..32: note = chr6:167837812-167837844
  misc_feature 1..32: note = Hypo
  source 1..32: mol_type = genomic DNA

SEQ ID NO: 126802 - DNA, 30 bp, Homo sapiens; identical to SEQ ID NO: 95175
  misc_feature 1..30: note = chr6:168122238-168122268
  misc_feature 1..30: note = Hypo
  source 1..30: mol_type = genomic DNA

SEQ ID NO: 126803 - DNA, 152 bp, Homo sapiens; identical to SEQ ID NO: 95176
  misc_feature 1..152: note = chr6:168122617-168122769
  misc_feature 1..152: note = Hypo
  source 1..152: mol_type = genomic DNA

SEQ ID NO: 126804 - DNA, 30 bp, Homo sapiens; identical to SEQ ID NO: 95177
  misc_feature 1..30: note = chr6:168375613-168375643
  misc_feature 1..30: note = Hypo
  source 1..30: mol_type = genomic DNA

SEQ ID NO: 126805 - DNA, 191 bp, Homo sapiens; identical to SEQ ID NO: 95178
  misc_feature 1..191: note = chr6:168376093-168376284
  misc_feature 1..191: note = Hypo
  source 1..191: mol_type = genomic DNA

SEQ ID NO: 126806 - DNA, 207 bp, Homo sapiens; identical to SEQ ID NO: 95179
  misc_feature 1..207: note = chr6:168377401-168377608
  misc_feature 1..207: note = Hypo
  source 1..207: mol_type = genomic DNA

SEQ ID NO: 126807 - DNA, 33 bp, Homo sapiens; identical to SEQ ID NO: 40990
  misc_feature 1..33: note = chr6:168399961-168399994
  misc_feature 1..33: note = Hypo
  source 1..33: mol_type = genomic DNA

SEQ ID NO: 126808 - DNA, 204 bp, Homo sapiens; identical to SEQ ID NO: 95181
  misc_feature 1..204: note = chr6:168453289-168453493
  misc_feature 1..204: note = Hypo
  source 1..204: mol_type = genomic DNA

SEQ ID NO: 126809 - DNA, 36 bp, Homo sapiens; identical to SEQ ID NO: 95182
  misc_feature 1..36: note = chr6:168462485-168462521
  misc_feature 1..36: note = Hypo
  source 1..36: mol_type = genomic DNA

SEQ ID NO: 126810 - DNA, 30 bp, Homo sapiens; identical to SEQ ID NO: 95183
  misc_feature 1..30: note = chr6:168479771-168479801
  misc_feature 1..30: note = Hypo
  source 1..30: mol_type = genomic DNA

SEQ ID NO: 126811 - DNA, 274 bp, Homo sapiens
  misc_feature 1..274: note = chr6:168719798-168720072
  misc_feature 1..274: note = Hyper
  source 1..274: mol_type = genomic DNA
gtaggcgcacatccacgcacggcggagcgcgggctgcagccccgggcagttttcagggtcctcacctgtgcgcttcacctctaggcacctgcgcgcggggcctccatgtccccctccttggagaccgaactgcattccattcaaatcccaaaggacgtcccctccatccatcagacacccccgtcccactaacacacagtcgctgccgaaggagcagcgcctgtggcccgcacacctcgcagccccgagtcccggcgcccggtccttaccagct

SEQ ID NO: 126812 - DNA, 58 bp, Homo sapiens; identical to SEQ ID NO: 95186
  misc_feature 1..58: note = chr6:168760650-168760708
  misc_feature 1..58: note = Hypo
  source 1..58: mol_type = genomic DNA

SEQ ID NO: 126813 - DNA, 180 bp, Homo sapiens; identical to SEQ ID NO: 95187
  misc_feature 1..180: note = chr6:168771518-168771698
  misc_feature 1..180: note = Hypo
  source 1..180: mol_type = genomic DNA

SEQ ID NO: 126814 - DNA, 1095 bp, Homo sapiens
  misc_feature 1..1095: note = chr6:168841423-168842518
  misc_feature 1..1095: note = Hyper
  source 1..1095: mol_type = genomic DNA
gtggatgaaaagtcccgctgggctgatcctgcgcggaccgggcctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacggtaagcccgggcccgcgggacctggagctcaagtggtgccgcctcttgcagccggccgggttcgggtccccgcgccccgctccaggcccaggcgcctgggcacggggagcaggtggccccgggggccgtggagccttcgcctgccggcgaggctggagcaggtaggacgcagcgtgcgcgcctgggacccggctgggatgggcttctggggaccctgcccgccggggtcctgctgcggctgcgacgggctcctcgggttccacccggctgggaccccacctgcctcgggggctctgacccggctgtgagaggatcctggggtcctgcagaccccggacaagtgggagctgcgggtgcgctcgggtgtcccgcactcactgctgg

SEQ ID NO: 126815 - DNA, 401 bp, Homo sapiens
  misc_feature 1..401: note = chr6:168842858-168843259
  misc_feature 1..401: note = Hyper
  source 1..401: mol_type = genomic DNA
caggcggcggctccccgctctgcggggcctctgggttcttcctcgtggcagggatgctgcgctcctgagcgcgagggtcaccgcggttgaccgctgtgtgtttttctttctgagctgtaacttctatgcgacagccttggcccggccaacgcacgcggtgtcaaacgaggagctatgtagagggggctgagccaagcccccgccggccaagccaacccgcggcggccgctgggccaaggccgggtgtctgcagcccccagctccagccgtcctcctgggcttgcagggtttgcaaacccatcattaatgcaatcgccagaaacgaaaacattccacttaaatgtgtttttgaacaagtgtttgagaaaacacgaaggtagtgagaacgcctctggtggaca

SEQ ID NO: 126816 - DNA, 248 bp, Homo sapiens; identical to SEQ ID NO: 95192
  misc_feature 1..248: note = chr6:168858091-168858339
  misc_feature 1..248: note = Hypo
  source 1..248: mol_type = genomic DNA

SEQ ID NO: 126817 - DNA, 177 bp, Homo sapiens; identical to SEQ ID NO: 95193
  misc_feature 1..177: note = chr6:168947622-168947799
  misc_feature 1..177: note = Hypo
  source 1..177: mol_type = genomic DNA

SEQ ID NO: 126818 - DNA, 66 bp, Homo sapiens; identical to SEQ ID NO: 95194
  misc_feature 1..66: note = chr6:168983395-168983461
  misc_feature 1..66: note = Hypo
  source 1..66: mol_type = genomic DNA

SEQ ID NO: 126819 - DNA, 128 bp, Homo sapiens; identical to SEQ ID NO: 95195
  misc_feature 1..128: note = chr6:168999540-168999668
  misc_feature 1..128: note = Hypo
  source 1..128: mol_type = genomic DNA

SEQ ID NO: 126820 - DNA, 32 bp, Homo sapiens; identical to SEQ ID NO: 95196
  misc_feature 1..32: note = chr6:169067893-169067925
  misc_feature 1..32: note = Hypo
  source 1..32: mol_type = genomic DNA

SEQ ID NO: 126821 - DNA, 30 bp, Homo sapiens; identical to SEQ ID NO: 95197
  misc_feature 1..30: note = chr6:169102398-169102428
  misc_feature 1..30: note = Hypo
  source 1..30: mol_type = genomic DNA

SEQ ID NO: 126822 - DNA, 51 bp, Homo sapiens; identical to SEQ ID NO: 95198
  misc_feature 1..51: note = chr6:169105616-169105667
  misc_feature 1..51: note = Hypo
  source 1..51: mol_type = genomic DNA

SEQ ID NO: 126823 - DNA, 41 bp, Homo sapiens; identical to SEQ ID NO: 95199
  misc_feature 1..41: note = chr6:169400235-169400276
  misc_feature 1..41: note = Hypo
  source 1..41: mol_type = genomic DNA

SEQ ID NO: 126824 - DNA, 138 bp, Homo sapiens; identical to SEQ ID NO: 95200
  misc_feature 1..138: note = chr6:169462691-169462829
  misc_feature 1..138: note = Hypo
  source 1..138: mol_type = genomic DNA

SEQ ID NO: 126825 - DNA, 165 bp, Homo sapiens; identical to SEQ ID NO: 95201
  misc_feature 1..165: note = chr6:169539538-169539703
  misc_feature 1..165: note = Hypo
  source 1..165: mol_type = genomic DNA

SEQ ID NO: 126826 - DNA, 169 bp, Homo sapiens; identical to SEQ ID NO: 95202
  misc_feature 1..169: note = chr6:169562391-169562560
  misc_feature 1..169: note = Hypo
  source 1..169: mol_type = genomic DNA

SEQ ID NO: 126827 - DNA, 177 bp, Homo sapiens; identical to SEQ ID NO: 95203
  misc_feature 1..177: note = chr6:169562792-169562969
  misc_feature 1..177: note = Hypo
  source 1..177: mol_type = genomic DNA

SEQ ID NO: 126828 - DNA, 107 bp, Homo sapiens; identical to SEQ ID NO: 95204
  misc_feature 1..107: note = chr6:169567826-169567933
  misc_feature 1..107: note = Hypo
  source 1..107: mol_type = genomic DNA

SEQ ID NO: 126829 - DNA, 30 bp, Homo sapiens; identical to SEQ ID NO: 95205
  misc_feature 1..30: note = chr6:169571409-169571439
  misc_feature 1..30: note = Hypo
  source 1..30: mol_type = genomic DNA

SEQ ID NO: 126830 - DNA, 496 bp, Homo sapiens; identical to SEQ ID NO: 95206
  misc_feature 1..496: note = chr6:169632340-169632836
  misc_feature 1..496: note = Hypo
  source 1..496: mol_type = genomic DNA

SEQ ID NO: 126831 - DNA, 39 bp, Homo sapiens; identical to SEQ ID NO: 95207
  misc_feature 1..39: note = chr6:169633129-169633168
  misc_feature 1..39: note = Hypo
  source 1..39: mol_type = genomic DNA

SEQ ID NO: 126832 - DNA, 30 bp, Homo sapiens; identical to SEQ ID NO: 95208
  misc_feature 1..30: note = chr6:169634777-169634807
  misc_feature 1..30: note = Hypo
  source 1..30: mol_type = genomic DNA

SEQ ID NO: 126833 - DNA, 118 bp, Homo sapiens; identical to SEQ ID NO: 95209
  misc_feature 1..118: note = chr6:169637173-169637291
  misc_feature 1..118: note = Hypo
  source 1..118: mol_type = genomic DNA

SEQ ID NO: 126834 - DNA, 35 bp, Homo sapiens; identical to SEQ ID NO: 40999
  misc_feature 1..35: note = chr6:169637816-169637851
  misc_feature 1..35: note = Hypo
  source 1..35: mol_type = genomic DNA

SEQ ID NO: 126835 - DNA, 42 bp, Homo sapiens; identical to SEQ ID NO: 95211
  misc_feature 1..42: note = chr6:169640567-169640609
  misc_feature 1..42: note = Hypo
  source 1..42: mol_type = genomic DNA

SEQ ID NO: 126836 - DNA, 116 bp, Homo sapiens; identical to SEQ ID NO: 95212
  misc_feature 1..116: note = chr6:169641889-169642005
  misc_feature 1..116: note = Hypo
  source 1..116: mol_type = genomic DNA

SEQ ID NO: 126837 - DNA, 454 bp, Homo sapiens; identical to SEQ ID NO: 95213
  misc_feature 1..454: note = chr6:169653638-169654092
  misc_feature 1..454: note = Hyper
  source 1..454: mol_type = genomic DNA

SEQ ID NO: 126838 - DNA, 42 bp, Homo sapiens; identical to SEQ ID NO: 95214
  misc_feature 1..42: note = chr6:169713648-169713690
  misc_feature 1..42: note = Hypo
  source 1..42: mol_type = genomic DNA

SEQ ID NO: 126839 - DNA, 48 bp, Homo sapiens; identical to SEQ ID NO: 95215
  misc_feature 1..48: note = chr6:169740765-169740813
  misc_feature 1..48: note = Hypo
  source 1..48: mol_type = genomic DNA

SEQ ID NO: 126840 - DNA, 36 bp, Homo sapiens; identical to SEQ ID NO: 95216
  misc_feature 1..36: note = chr6:169852398-169852434
  misc_feature 1..36: note = Hypo
  source 1..36: mol_type = genomic DNA

SEQ ID NO: 126841 - DNA, 30 bp, Homo sapiens; identical to SEQ ID NO: 41002
  misc_feature 1..30: note = chr6:170065367-170065397
  misc_feature 1..30: note = Hypo
  source 1..30: mol_type = genomic DNA

SEQ ID NO: 126842 - DNA, 45 bp, Homo sapiens; identical to SEQ ID NO: 95218
  misc_feature 1..45: note = chr6:170091017-170091062
  misc_feature 1..45: note = Hypo
  source 1..45: mol_type = genomic DNA

SEQ ID NO: 126843 - DNA, 30 bp, Homo sapiens; identical to SEQ ID NO: 41003
  misc_feature 1..30: note = chr6:170201723-170201753
  misc_feature 1..30: note = Hypo
  source 1..30: mol_type = genomic DNA

SEQ ID NO: 126844 - DNA, 30 bp, Homo sapiens; identical to SEQ ID NO: 41004
  misc_feature 1..30: note = chr6:170240081-170240111
  misc_feature 1..30: note = Hypo
  source 1..30: mol_type = genomic DNA

SEQ ID NO: 126845 - DNA, 30 bp, Homo sapiens; identical to SEQ ID NO: 95221
  misc_feature 1..30: note = chr6:170240765-170240795
  misc_feature 1..30: note = Hypo
  source 1..30: mol_type = genomic DNA

SEQ ID NO: 126846 - DNA, 30 bp, Homo sapiens; identical to SEQ ID NO: 95222
  misc_feature 1..30: note = chr6:170249406-170249436
  misc_feature 1..30: note = Hypo
  source 1..30: mol_type = genomic DNA

SEQ ID NO: 126847 - DNA, 50 bp, Homo sapiens; identical to SEQ ID NO: 95223
  misc_feature 1..50: note = chr6:170263200-170263250
  misc_feature 1..50: note = Hypo
  source 1..50: mol_type = genomic DNA

SEQ ID NO: 126848 - DNA, 42 bp, Homo sapiens; identical to SEQ ID NO: 95224
  misc_feature 1..42: note = chr6:170264728-170264770
  misc_feature 1..42: note = Hypo
  source 1..42: mol_type = genomic DNA

SEQ ID NO: 126849 - DNA, 139 bp, Homo sapiens; identical to SEQ ID NO: 95225
  misc_feature 1..139: note = chr6:170339404-170339543
  misc_feature 1..139: note = Hypo
  source 1..139: mol_type = genomic DNA

SEQ ID NO: 126850 - DNA, 30 bp, Homo sapiens; identical to SEQ ID NO: 95226
  misc_feature 1..30: note = chr6:170343912-170343942
  misc_feature 1..30: note = Hypo
  source 1..30: mol_type = genomic DNA

SEQ ID NO: 126851 - DNA, 30 bp, Homo sapiens; identical to SEQ ID NO: 41006
  misc_feature 1..30: note = chr6:170361487-170361517
  misc_feature 1..30: note = Hypo
  source 1..30: mol_type = genomic DNA

SEQ ID NO: 126852 - DNA, 30 bp, Homo sapiens; identical to SEQ ID NO: 95228
  misc_feature 1..30: note = chr6:170365462-170365492
  misc_feature 1..30: note = Hypo
  source 1..30: mol_type = genomic DNA

SEQ ID NO: 126853 - DNA, 30 bp, Homo sapiens; identical to SEQ ID NO: 41007
  misc_feature 1..30: note = chr6:170368767-170368797
  misc_feature 1..30: note = Hypo
  source 1..30: mol_type = genomic DNA

SEQ ID NO: 126854 - DNA, 30 bp, Homo sapiens; identical to SEQ ID NO: 95230
  misc_feature 1..30: note = chr6:170371320-170371350
  misc_feature 1..30: note = Hypo
  source 1..30: mol_type = genomic DNA

SEQ ID NO: 126855 - DNA, 30 bp, Homo sapiens; identical to SEQ ID NO: 95231
  misc_feature 1..30: note = chr6:170374015-170374045
  misc_feature 1..30: note = Hypo
  source 1..30: mol_type = genomic DNA

SEQ ID NO: 126856 - DNA, 42 bp, Homo sapiens; identical to SEQ ID NO: 95232
  misc_feature 1..42: note = chr6:170392903-170392945
  misc_feature 1..42: note = Hypo
  source 1..42: mol_type = genomic DNA

SEQ ID NO: 126857 - DNA, 323 bp, Homo sapiens; identical to SEQ ID NO: 95233
  misc_feature 1..323: note = chr6:170402281-170402604
  misc_feature 1..323: note = Hypo
  source 1..323: mol_type = genomic DNA

SEQ ID NO: 126858 - DNA, 38 bp, Homo sapiens; identical to SEQ ID NO: 95234
  misc_feature 1..38: note = chr6:170408290-170408328
  misc_feature 1..38: note = Hypo
  source 1..38: mol_type = genomic DNA

SEQ ID NO: 126859 - DNA, 32 bp, Homo sapiens; identical to SEQ ID NO: 95235
  misc_feature 1..32: note = chr6:170409702-170409734
  misc_feature 1..32: note = Hypo
  source 1..32: mol_type = genomic DNA

SEQ ID NO: 126860 - DNA, 114 bp, Homo sapiens; identical to SEQ ID NO: 95236
  misc_feature 1..114: note = chr6:170413679-170413793
  misc_feature 1..114: note = Hypo
  source 1..114: mol_type = genomic DNA

SEQ ID NO: 126861 - DNA, 138 bp, Homo sapiens; identical to SEQ ID NO: 95237
  misc_feature 1..138: note = chr6:170454062-170454200
  misc_feature 1..138: note = Hypo
  source 1..138: mol_type = genomic DNA

SEQ ID NO: 126862 - DNA, 781 bp, Homo sapiens; identical to SEQ ID NO: 95238
  misc_feature 1..781: note = chr6:170474843-170475624
  misc_feature 1..781: note = Hypo
  source 1..781: mol_type = genomic DNA

SEQ ID NO: 126863 - DNA, 48 bp, Homo sapiens; identical to SEQ ID NO: 95239
  misc_feature 1..48: note = chr6:170475958-170476006
  misc_feature 1..48: note = Hypo
  source 1..48: mol_type = genomic DNA

SEQ ID NO: 126864 - DNA, 142 bp, Homo sapiens; identical to SEQ ID NO: 95240
  misc_feature 1..142: note = chr6:170493059-170493201
  misc_feature 1..142: note = Hypo
  source 1..142: mol_type = genomic DNA

SEQ ID NO: 126865 - DNA, 126 bp, Homo sapiens; identical to SEQ ID NO: 95241
  misc_feature 1..126: note = chr6:170526716-170526842
  misc_feature 1..126: note = Hypo
  source 1..126: mol_type = genomic DNA

SEQ ID NO: 126866 - DNA, 30 bp, Homo sapiens; identical to SEQ ID NO: 95242
  misc_feature 1..30: note = chr6:170538913-170538943
  misc_feature 1..30: note = Hypo
  source 1..30: mol_type = genomic DNA

SEQ ID NO: 126867 - DNA, 142 bp, Homo sapiens; identical to SEQ ID NO: 95243
  misc_feature 1..142: note = chr6:170569776-170569918
  misc_feature 1..142: note = Hypo
  source 1..142: mol_type = genomic DNA

SEQ ID NO: 126868 - DNA, 76 bp, Homo sapiens; identical to SEQ ID NO: 95244
  misc_feature 1..76: note = chr6:170579513-170579589
  misc_feature 1..76: note = Hypo
  source 1..76: mol_type = genomic DNA

SEQ ID NO: 126869 - DNA, 30 bp, Homo sapiens; identical to SEQ ID NO: 95245
  misc_feature 1..30: note = chr6:170592975-170593005
  misc_feature 1..30: note = Hypo
  source 1..30: mol_type = genomic DNA

SEQ ID NO: 126870 - DNA, 636 bp, Homo sapiens
  misc_feature 1..636: note = chr6:170598204-170598840
  misc_feature 1..636: note = Hyper
  source 1..636: mol_type = genomic DNA
gggatgggcacgctccgggtggtagcggtcgcgctgcgcgggtaatcgcgccaccaacgcgtctaggagtcgggaaaccagaaccttcccacgtgaaggggcgcctctgactggagacctggcacagaggccggatacggaaatctcccgggcgcgctcggcctctcctcctcgccccagcgcggtcccctcctgcaggccgcggggccccggggcgaggtgtccgcgctgctgggctggagtcctggggccgccgctaggcagatcgcagcgcccacctgcgcctcgcggggtccccgaggtcccgccaccgagcgcccaaggcgggatcccagcgcgtcctgcagcccgcccagcttcagggccggcccggcgcgcgcaggtgcggcactcaccggccaggtgaagccgaaggggaagcggatggggttgctgaacgcggagtcggcgcccccgccgtcgggcagactgaaggagtcgacgcccagcacgggggtgacggcgctgccgtaggtgcagggcggctcgggggacacgctggcctggtagtgcttgaggcacacgcggaagaaggtccggcaggcgcacggcggtggccccgcgcccccgcggcagcagttgcggttccccagcagc

SEQ ID NO: 126871 - DNA, 420 bp, Homo sapiens
  misc_feature 1..420: note = chr6:170605520-170605940
  misc_feature 1..420: note = Hyper
  source 1..420: mol_type = genomic DNA
gggccactgcgagggcggagggcggcgccagggccctcccggtggaccccagtcgccgtcgtgacggccccacgcagcctcgcgcccggccgccgcctcgtgcgggactcgtgcccgcattcccacctcaccgggtgcagccggcccggccccgggctgtgcgaggcgacggcgcacacctcggagccctgggggccggggtcggcgggcggggccggggcgcgccctttgtgcgctcttagcggaaaccgcgcgttcccagaggagcgcggcccgccgagaccccggatcccgacgccaggaggtgctgcaggagcccgcgcggggtgggggtctccggcccaggcccctcggtacgggccccctgcggccgccaccctccgcctccgcgcggcggctcctttccggctgcatccgggg

SEQ ID NO: 126872 - DNA, 45 bp, Homo sapiens; identical to SEQ ID NO: 95250
  misc_feature 1..45: note = chr6:170757555-170757600
  misc_feature 1..45: note = Hypo
  source 1..45: mol_type = genomic DNA

SEQ ID NO: 126873 - DNA, 87 bp, Homo sapiens; identical to SEQ ID NO: 95252
  misc_feature 1..87: note = chr6:170921658-170921745
  misc_feature 1..87: note = Hyper
  source 1..87: mol_type = genomic DNA

SEQ ID NO: 126874 - DNA, 30 bp, Homo sapiens; identical to SEQ ID NO: 98159
  misc_feature 1..30: note = chr7:88719-88749
  misc_feature 1..30: note = Hypo
  source 1..30: mol_type = genomic DNA

SEQ ID NO: 126875 - DNA, 30 bp, Homo sapiens; identical to SEQ ID NO: 96249
  misc_feature 1..30: note = chr7:121074-121104
  misc_feature 1..30: note = Hypo
  source 1..30: mol_type = genomic DNA

SEQ ID NO: 126876 - DNA, 167 bp, Homo sapiens; identical to SEQ ID NO: 41015
  misc_feature 1..167: note = chr7:131076-131243
  misc_feature 1..167: note = Hypo
  source 1..167: mol_type = genomic DNA

SEQ ID NO: 126877 - DNA, 110 bp, Homo sapiens; identical to SEQ ID NO: 96576
  misc_feature 1..110: note = chr7:149110-149220
  misc_feature 1..110: note = Hyper
  source 1..110: mol_type = genomic DNA

SEQ ID NO: 126878 - DNA, 193 bp, Homo sapiens; identical to SEQ ID NO: 97098
  misc_feature 1..193: note = chr7:171314-171507
  misc_feature 1..193: note = Hypo
  source 1..193: mol_type = genomic DNA

SEQ ID NO: 126879 - DNA, 30 bp, Homo sapiens; identical to SEQ ID NO: 97105
  misc_feature 1..30: note = chr7:173466-173496
  misc_feature 1..30: note = Hypo
  source 1..30: mol_type = genomic DNA

SEQ ID NO: 126880 - DNA, 51 bp, Homo sapiens; identical to SEQ ID NO: 97129
  misc_feature 1..51: note = chr7:186628-186679
  misc_feature 1..51: note = Hypo
  source 1..51: mol_type = genomic DNA

SEQ ID NO: 126881 - DNA, 90 bp, Homo sapiens; identical to SEQ ID NO: 97147
  misc_feature 1..90: note = chr7:191827-191917
  misc_feature 1..90: note = Hyper
  source 1..90: mol_type = genomic DNA

SEQ ID NO: 126882 - DNA, 184 bp, Homo sapiens; identical to SEQ ID NO: 97152
  misc_feature 1..184: note = chr7:192430-192614
  misc_feature 1..184: note = Hyper
  source 1..184: mol_type = genomic DNA

SEQ ID NO: 126883 - DNA, 125 bp, Homo sapiens; identical to SEQ ID NO: 97153
  misc_feature 1..125: note = chr7:192976-193101
  misc_feature 1..125: note = Hyper
  source 1..125: mol_type = genomic DNA

SEQ ID NO: 126884 - DNA, 96 bp, Homo sapiens; identical to SEQ ID NO: 97155
  misc_feature 1..96: note = chr7:193612-193708
  misc_feature 1..96: note = Hyper
  source 1..96: mol_type = genomic DNA

SEQ ID NO: 126885 - DNA, 39 bp, Homo sapiens; identical to SEQ ID NO: 97156
  misc_feature 1..39: note = chr7:193984-194023
  misc_feature 1..39: note = Hyper
  source 1..39: mol_type = genomic DNA

SEQ ID NO: 126886 - DNA, 30 bp, Homo sapiens; identical to SEQ ID NO: 97188
  misc_feature 1..30: note = chr7:208441-208471
  misc_feature 1..30: note = Hypo
  source 1..30: mol_type = genomic DNA

SEQ ID NO: 126887 - DNA, 50 bp, Homo sapiens; identical to SEQ ID NO: 97378
  misc_feature 1..50: note = chr7:288278-288328
  misc_feature 1..50: note = Hypo
  source 1..50: mol_type = genomic DNA

SEQ ID NO: 126888 - DNA, 69 bp, Homo sapiens; identical to SEQ ID NO: 97394
  misc_feature 1..69: note = chr7:294045-294114
  misc_feature 1..69: note = Hypo
  source 1..69: mol_type = genomic DNA

SEQ ID NO: 126889 - DNA, 67 bp, Homo sapiens; identical to SEQ ID NO: 97408
  misc_feature 1..67: note = chr7:297499-297566
  misc_feature 1..67: note = Hypo
  source 1..67: mol_type = genomic DNA

SEQ ID NO: 126890 - DNA, 114 bp, Homo sapiens; identical to SEQ ID NO: 97429
  misc_feature 1..114: note = chr7:306957-307071
  misc_feature 1..114: note = Hypo
  source 1..114: mol_type = genomic DNA

SEQ ID NO: 126891 - DNA, 46 bp, Homo sapiens; identical to SEQ ID NO: 97450
  misc_feature 1..46: note = chr7:312592-312638
  misc_feature 1..46: note = Hypo
  source 1..46: mol_type = genomic DNA

SEQ ID NO: 126892 - DNA, 216 bp, Homo sapiens; identical to SEQ ID NO: 97461
  misc_feature 1..216: note = chr7:322599-322815
  misc_feature 1..216: note = Hypo
  source 1..216: mol_type = genomic DNA

SEQ ID NO: 126893 - DNA, 160 bp, Homo sapiens; identical to SEQ ID NO: 97471
  misc_feature 1..160: note = chr7:328246-328406
  misc_feature 1..160: note = Hypo
  source 1..160: mol_type = genomic DNA

SEQ ID NO: 126894 - DNA, 39 bp, Homo sapiens; identical to SEQ ID NO: 97473
  misc_feature 1..39: note = chr7:328586-328625
  misc_feature 1..39: note = Hypo
  source 1..39: mol_type = genomic DNA

SEQ ID NO: 126895 - DNA, 309 bp, Homo sapiens
  misc_feature 1..309: note = chr7:329622-329931
  misc_feature 1..309: note = Hyper
  source 1..309: mol_type = genomic DNA
cccggaaagcaccaccgagtctcaggcgcgcccagggcgcacgggaccggggctcacggcaccggggcgctccgaggagacttccgccagtgcagggagcctgcgaggacaccccaagctgcctccagggacggggacggagcgagccctgccctgagcgccccaggaagggagccgggtagggggggccgccccgcccgtcggaccacccagcgcgccgcctcctcctccctccccccgcggcggtcagagggtcacccagacgccccacaccgctcccctcggccgctttaccggtggctggggcct

SEQ ID NO: 126896 - DNA, 549 bp, Homo sapiens
  misc_feature 1..549: note = chr7:330320-330869
  misc_feature 1..549: note = Hyper
  source 1..549: mol_type = genomic DNA
gggacgaaggaagggcgggggagctttcttctctccggcggcggagctcagagaaaggacgcatttgtccctactttggggagagccagggagggttcttggcctcgcggggaggggcctccgcaggtcgggaaagagcttctggggtctgggtggcgccggggaccgcgagctgcggggacactttccccaacaccgcctcgctcctccgcctctgcgccccacggcgtcctgcgggatggggggaaggacggggggctgcccggtggagaccccgcctgacccccgggctccgcagctacatcgccttgatcgccatggccattcagcagagccccgcggggagggtgaccctgtccggcatctacgacttcatcatgcgcaaattcccctattaccgcgccaaccagcgcgcctggcagaactccatccgccacaacctgtccctcaacagctgcttcgtcaaggtgagcgccgcccccgacgggccccgggtgtcccagcgtggcgacacctgcgccagggcctcggtggcggggaagggagggc

SEQ ID NO: 126897 - DNA, 30 bp, Homo sapiens; identical to SEQ ID NO: 97487
  misc_feature 1..30: note = chr7:341655-341685
  misc_feature 1..30: note = Hypo
  source 1..30: mol_type = genomic DNA

SEQ ID NO: 126898 - DNA, 313 bp, Homo sapiens; identical to SEQ ID NO: 97488
  misc_feature 1..313: note = chr7:345295-345608
  misc_feature 1..313: note = Hypo
  source 1..313: mol_type = genomic DNA

SEQ ID NO: 126899 - DNA, 30 bp, Homo sapiens; identical to SEQ ID NO: 97509
  misc_feature 1..30: note = chr7:355057-355087
  misc_feature 1..30: note = Hypo
  source 1..30: mol_type = genomic DNA

SEQ ID NO: 126900 - DNA, 272 bp, Homo sapiens; identical to SEQ ID NO: 97516
  misc_feature 1..272: note = chr7:369844-370116
  misc_feature 1..272: note = Hypo
  source 1..272: mol_type = genomic DNA

SEQ ID NO: 126901 - DNA, 32 bp, Homo sapiens; identical to SEQ ID NO: 97552
  misc_feature 1..32: note = chr7:380766-380798
  misc_feature 1..32: note = Hypo
  source 1..32: mol_type = genomic DNA

SEQ ID NO: 126902 - DNA, 30 bp, Homo sapiens; identical to SEQ ID NO: 41021
  misc_feature 1..30: note = chr7:381568-381598
  misc_feature 1..30: note = Hypo
  source 1..30: mol_type = genomic DNA

SEQ ID NO: 126903 - DNA, 34 bp, Homo sapiens; identical to SEQ ID NO: 97563
  misc_feature 1..34: note = chr7:387990-388024
  misc_feature 1..34: note = Hypo
  source 1..34: mol_type = genomic DNA

SEQ ID NO: 126904 - DNA, 239 bp, Homo sapiens; identical to SEQ ID NO: 97564
  misc_feature 1..239: note = chr7:389663-389902
  misc_feature 1..239: note = Hypo
  source 1..239: mol_type = genomic DNA

SEQ ID NO: 126905 - DNA, 179 bp, Homo sapiens; identical to SEQ ID NO: 41023
  misc_feature 1..179: note = chr7:409602-409781
  misc_feature 1..179: note = Hypo
  source 1..179: mol_type = genomic DNA

SEQ ID NO: 126906 - DNA, 459 bp, Homo sapiens; identical to SEQ ID NO: 97588
  misc_feature 1..459: note = chr7:409986-410445
  misc_feature 1..459: note = Hypo
  source 1..459: mol_type = genomic DNA

SEQ ID NO: 126907 - DNA, 30 bp, Homo sapiens; identical to SEQ ID NO: 97593
  misc_feature 1..30: note = chr7:414915-414945
  misc_feature 1..30: note = Hypo
  source 1..30: mol_type = genomic DNA

SEQ ID NO: 126908 - DNA, 132 bp, Homo sapiens; identical to SEQ ID NO: 97625
  misc_feature 1..132: note = chr7:430257-430389
  misc_feature 1..132: note = Hypo
  source 1..132: mol_type = genomic DNA

SEQ ID NO: 126909 - DNA, 397 bp, Homo sapiens; identical to SEQ ID NO: 97627
  misc_feature 1..397: note = chr7:431386-431783
  misc_feature 1..397: note = Hypo
  source 1..397: mol_type = genomic DNA

SEQ ID NO: 126910 - DNA, 109 bp, Homo sapiens; identical to SEQ ID NO: 97681
  misc_feature 1..109: note = chr7:450465-450574
  misc_feature 1..109: note = Hypo
  source 1..109: mol_type = genomic DNA

SEQ ID NO: 126911 - DNA, 30 bp, Homo sapiens; identical to SEQ ID NO: 97688
  misc_feature 1..30: note = chr7:453753-453783
  misc_feature 1..30: note = Hypo
  source 1..30: mol_type = genomic DNA

SEQ ID NO: 126912 - DNA, 30 bp, Homo sapiens; identical to SEQ ID NO: 97699
  misc_feature 1..30: note = chr7:466547-466577
  misc_feature 1..30: note = Hypo
  source 1..30: mol_type = genomic DNA

SEQ ID NO: 126913 - DNA, 37 bp, Homo sapiens; identical to SEQ ID NO: 97700
  misc_feature 1..37: note = chr7:471149-471186
  misc_feature 1..37: note = Hypo
  source 1..37: mol_type = genomic DNA

SEQ ID NO: 126914 - DNA, 53 bp, Homo sapiens; identical to SEQ ID NO: 97701
  misc_feature 1..53: note = chr7:472685-472738
  misc_feature 1..53: note = Hypo
  source 1..53: mol_type = genomic DNA

SEQ ID NO: 126915 - DNA, 119 bp, Homo sapiens; identical to SEQ ID NO: 97712
  misc_feature 1..119: note = chr7:476416-476535
  misc_feature 1..119: note = Hypo
  source 1..119: mol_type = genomic DNA

SEQ ID NO: 126916 - DNA, 49 bp, Homo sapiens; identical to SEQ ID NO: 97746
  misc_feature 1..49: note = chr7:494963-495012
  misc_feature 1..49: note = Hypo
  source 1..49: mol_type = genomic DNA

SEQ ID NO: 126917 - DNA, 167 bp, Homo sapiens; identical to SEQ ID NO: 41029
  misc_feature 1..167: note = chr7:497742-497909
  misc_feature 1..167: note = Hypo
  source 1..167: mol_type = genomic DNA

SEQ ID NO: 126918 - DNA, 100 bp, Homo sapiens; identical to SEQ ID NO: 97763
  misc_feature 1..100: note = chr7:502263-502363
  misc_feature 1..100: note = Hypo
  source 1..100: mol_type = genomic DNA

SEQ ID NO: 126919 - DNA, 392 bp, Homo sapiens; identical to SEQ ID NO: 97768
  misc_feature 1..392: note = chr7:502708-503100
  misc_feature 1..392: note = Hypo
  source 1..392: mol_type = genomic DNA

SEQ ID NO: 126920 - DNA, 354 bp, Homo sapiens; identical to SEQ ID NO: 97778
  misc_feature 1..354: note = chr7:503676-504030
  misc_feature 1..354: note = Hypo
  source 1..354: mol_type = genomic DNA

SEQ ID NO: 126921 - DNA, 125 bp, Homo sapiens; identical to SEQ ID NO: 97807
  misc_feature 1..125: note = chr7:532811-532936
  misc_feature 1..125: note = Hypo
  source 1..125: mol_type = genomic DNA

SEQ ID NO: 126922 - DNA, 37 bp, Homo sapiens; identical to SEQ ID NO: 97813
  misc_feature 1..37: note = chr7:543015-543052
  misc_feature 1..37: note = Hypo
  source 1..37: mol_type = genomic DNA

SEQ ID NO: 126923 - DNA, 112 bp, Homo sapiens; identical to SEQ ID NO: 41034
  misc_feature 1..112: note = chr7:551572-551684
  misc_feature 1..112: note = Hypo
  source 1..112: mol_type = genomic DNA

SEQ ID NO: 126924 - DNA, 66 bp, Homo sapiens; identical to SEQ ID NO: 97837
  misc_feature 1..66: note = chr7:551953-552019
  misc_feature 1..66: note = Hypo
  source 1..66: mol_type = genomic DNA

SEQ ID NO: 126925 - DNA, 142 bp, Homo sapiens; identical to SEQ ID NO: 97840
  misc_feature 1..142: note = chr7:552953-553095
  misc_feature 1..142: note = Hypo
  source 1..142: mol_type = genomic DNA

SEQ ID NO: 126926 - DNA, 30 bp, Homo sapiens; identical to SEQ ID NO: 97846
  misc_feature 1..30: note = chr7:556686-556716
  misc_feature 1..30: note = Hyper
  source 1..30: mol_type = genomic DNA

SEQ ID NO: 126927 - DNA, 127 bp, Homo sapiens; identical to SEQ ID NO: 97847
  misc_feature 1..127: note = chr7:557093-557220
  misc_feature 1..127: note = Hyper
  source 1..127: mol_type = genomic DNA

SEQ ID NO: 126928 - DNA, 161 bp, Homo sapiens; identical to SEQ ID NO: 97852
  misc_feature 1..161: note = chr7:560181-560342
  misc_feature 1..161: note = Hyper
  source 1..161: mol_type = genomic DNA

SEQ ID NO: 126929 - DNA, 40 bp, Homo sapiens; identical to SEQ ID NO: 97855
  misc_feature 1..40: note = chr7:560554-560594
  misc_feature 1..40: note = Hyper
  source 1..40: mol_type = genomic DNA

SEQ ID NO: 126930 - DNA, 317 bp, Homo sapiens; identical to SEQ ID NO: 97856
  misc_feature 1..317: note = chr7:560928-561245
  misc_feature 1..317: note = Hyper
  source 1..317: mol_type = genomic DNA

SEQ ID NO: 126931 - DNA, 211 bp, Homo sapiens; identical to SEQ ID NO: 97865
  misc_feature 1..211: note = chr7:562619-562830
  misc_feature 1..211: note = Hyper
  source 1..211: mol_type = genomic DNA

SEQ ID NO: 126932 - DNA, 30 bp, Homo sapiens; identical to SEQ ID NO: 97874
  misc_feature 1..30: note = chr7:572406-572436
  misc_feature 1..30: note = Hypo
  source 1..30: mol_type = genomic DNA

SEQ ID NO: 126933 - DNA, 126 bp, Homo sapiens; identical to SEQ ID NO: 41036
  misc_feature 1..126: note = chr7:578922-579048
  misc_feature 1..126: note = Hypo
  source 1..126: mol_type = genomic DNA

SEQ ID NO: 126934 - DNA, 68 bp, Homo sapiens; identical to SEQ ID NO: 97891
  misc_feature 1..68: note = chr7:612677-612745
  misc_feature 1..68: note = Hypo
  source 1..68: mol_type = genomic DNA

SEQ ID NO: 126935 - DNA, 30 bp, Homo sapiens; identical to SEQ ID NO: 98067
  misc_feature 1..30: note = chr7:746995-747025
  misc_feature 1..30: note = Hypo
  source 1..30: mol_type = genomic DNA

SEQ ID NO: 126936 - DNA, 718 bp, Homo sapiens
  misc_feature 1..718: note = chr7:751761-752479
  misc_feature 1..718: note = Hyper
  source 1..718: mol_type = genomic DNA
aggccggcaccgcaccgcggggcgcaggaccccagccccccgccacgccgcccccggagtgcccagaccgccgggaaggcgcccacccagagaccccgcgccccccgccccaaacccggcctcagcgccggcgaggaccctcccgggacccctgaccgggagccccaggcccggccccgccccgcgcgccccactcccggcggggccgaacccttccaaatgtccgcatccccggggggcctcccaggcccggggctcccggcgcagaccccagcccggccccgcgtacctggatgcgcggcgcccgaggccaggaggcggctgcgcggggacgcggggcgcggggacggctggcgagcgagcgagcgggtccccgcactgcagcggcgccgccctccacgcccgcccccgcgccgcgcgcagctgctgcacccccaacgccgcccgcgcgggcctgcagcccgtctccccccgaccgcctccccgcggggcccccaaccccggcccccacccccggctctccccgcccccgccccatcccccaccggcgcaggttcaggccatcgctgccaggaccccccgctgtcgccgccccccgccccctccactcagactctgagtcgcccactccagccggtgcaggccgcggggccgcctctgatggcctgggcaccccccactcccgccccgttcacgaccaccgcggctgcctgagctg

SEQ ID NO: 126937 - DNA, 368 bp, Homo sapiens; identical to SEQ ID NO: 98100
  misc_feature 1..368: note = chr7:803247-803615
  misc_feature 1..368: note = Hypo
  source 1..368: mol_type = genomic DNA

SEQ ID NO: 126938 - DNA, 49 bp, Homo sapiens; identical to SEQ ID NO: 98103
  misc_feature 1..49: note = chr7:808528-808577
  misc_feature 1..49: note = Hypo
  source 1..49: mol_type = genomic DNA

SEQ ID NO: 126939 - DNA, 30 bp, Homo sapiens; identical to SEQ ID NO: 98104
  misc_feature 1..30: note = chr7:808818-808848
  misc_feature 1..30: note = Hypo
  source 1..30: mol_type = genomic DNA

SEQ ID NO: 126940 - DNA, 298 bp, Homo sapiens; identical to SEQ ID NO: 98108
  misc_feature 1..298: note = chr7:819400-819698
  misc_feature 1..298: note = Hypo
  source 1..298: mol_type = genomic DNA

SEQ ID NO: 126941 - DNA, 570 bp, Homo sapiens; identical to SEQ ID NO: 98115
  misc_feature 1..570: note = chr7:834303-834873
  misc_feature 1..570: note = Hypo
  source 1..570: mol_type = genomic DNA

SEQ ID NO: 126942 - DNA, 207 bp, Homo sapiens; identical to SEQ ID NO: 98136
  misc_feature 1..207: note = chr7:852590-852797
  misc_feature 1..207: note = Hyper
  source 1..207: mol_type = genomic DNA

SEQ ID NO: 126943 - DNA, 30 bp, Homo sapiens; identical to SEQ ID NO: 41041
  misc_feature 1..30: note = chr7:907656-907686
  misc_feature 1..30: note = Hypo
  source 1..30: mol_type = genomic DNA

SEQ ID NO: 126944 - DNA, 328 bp, Homo sapiens
  misc_feature 1..328: note = chr7:915058-915386
  misc_feature 1..328: note = Hypo
  source 1..328: mol_type = genomic DNA
ccctgtaaatccaacggaggagtcttcggaccgaacggcgaaccgccttcaaaccccaattcttacagccaagccgttcccaaccctgcacggctagggctgggcctcaggccccgtttctaactctgactggggtttggaccccgtttccgcagcctgacagggctggaagctctaggccgacccagttcccccttccagcaggacccgatcctggaggagtgagccgtccacccaggcacagccgcaggtccccagccacggccagggaaggaccgcaggtggcctttcaaagaggaggaacgcccctcagcgatcctaagaggtt

SEQ ID NO: 126945 - DNA, 62 bp, Homo sapiens; identical to SEQ ID NO: 98181
  misc_feature 1..62: note = chr7:920918-920980
  misc_feature 1..62: note = Hypo
  source 1..62: mol_type = genomic DNA

SEQ ID NO: 126946 - DNA, 29 bp, Homo sapiens
  misc_feature 1..29: note = chr7:933292-933321
  misc_feature 1..29: note = Hypo
  source 1..29: mol_type = genomic DNA
gttgggcgcaggcgcggtggtttgtgcag

SEQ ID NO: 126947 - DNA, 396 bp, Homo sapiens; identical to SEQ ID NO: 98208
  misc_feature 1..396: note = chr7:959576-959972
  misc_feature 1..396: note = Hypo
  source 1..396: mol_type = genomic DNA

SEQ ID NO: 126948 - DNA, 37 bp, Homo sapiens; identical to SEQ ID NO: 98209
  misc_feature 1..37: note = chr7:965972-966009
  misc_feature 1..37: note = Hypo
  source 1..37: mol_type = genomic DNA

SEQ ID NO: 126949 - DNA, 221 bp, Homo sapiens; identical to SEQ ID NO: 98239
  misc_feature 1..221: note = chr7:966840-967061
  misc_feature 1..221: note = Hypo
  source 1..221: mol_type = genomic DNA

SEQ ID NO: 126950 - DNA, 30 bp, Homo sapiens; identical to SEQ ID NO: 98270
  misc_feature 1..30: note = chr7:978819-978849
  misc_feature 1..30: note = Hypo
  source 1..30: mol_type = genomic DNA

SEQ ID NO: 126951 - DNA, 102 bp, Homo sapiens; identical to SEQ ID NO: 98283
  misc_feature 1..102: note = chr7:986234-986336
  misc_feature 1..102: note = Hypo
  source 1..102: mol_type = genomic DNA

SEQ ID NO: 126952 - DNA, 95 bp, Homo sapiens; identical to SEQ ID NO: 98300
  misc_feature 1..95: note = chr7:994535-994630
  misc_feature 1..95: note = Hyper
  source 1..95: mol_type = genomic DNA

SEQ ID NO: 126953 - DNA, 30 bp, Homo sapiens; identical to SEQ ID NO: 98315
  misc_feature 1..30: note = chr7:998684-998714
  misc_feature 1..30: note = Hypo
  source 1..30: mol_type = genomic DNA

SEQ ID NO: 126954 - DNA, 30 bp, Homo sapiens; identical to SEQ ID NO: 96069
  misc_feature 1..30: note = chr7:1006918-1006948
  misc_feature 1..30: note = Hypo
  source 1..30: mol_type = genomic DNA

SEQ ID NO: 126955 - DNA, 30 bp, Homo sapiens; identical to SEQ ID NO: 96125
  misc_feature 1..30: note = chr7:1019055-1019085
  misc_feature 1..30: note = Hypo
  source 1..30: mol_type = genomic DNA

SEQ ID NO: 126956 - DNA, 212 bp, Homo sapiens; identical to SEQ ID NO: 96129
  misc_feature 1..212: note = chr7:1022042-1022254
  misc_feature 1..212: note = Hypo
  source 1..212: mol_type = genomic DNA

SEQ ID NO: 126957 - DNA, 79 bp, Homo sapiens; identical to SEQ ID NO: 96131
  misc_feature 1..79: note = chr7:1022888-1022967
  misc_feature 1..79: note = Hypo
  source 1..79: mol_type = genomic DNA

SEQ ID NO: 126958 - DNA, 52 bp, Homo sapiens; identical to SEQ ID NO: 96132
  misc_feature 1..52: note = chr7:1023349-1023401
  misc_feature 1..52: note = Hypo
  source 1..52: mol_type = genomic DNA

SEQ ID NO: 126959 - DNA, 624 bp, Homo sapiens; identical to SEQ ID NO: 96133
  misc_feature 1..624: note = chr7:1026795-1027419
  misc_feature 1..624: note = Hypo
  source 1..624: mol_type = genomic DNA

SEQ ID NO: 126960 - DNA, 328 bp, Homo sapiens; identical to SEQ ID NO: 96137
  misc_feature 1..328: note = chr7:1030000-1030328
  misc_feature 1..328: note = Hypo
  source 1..328: mol_type = genomic DNA

SEQ ID NO: 126961 - DNA, 182 bp, Homo sapiens; identical to SEQ ID NO: 96139
  misc_feature 1..182: note = chr7:1031815-1031997
  misc_feature 1..182: note = Hypo
  source 1..182: mol_type = genomic DNA

SEQ ID NO: 126962 - DNA, 85 bp, Homo sapiens; identical to SEQ ID NO: 96145
  misc_feature 1..85: note = chr7:1037221-1037306
  misc_feature 1..85: note = Hypo
  source 1..85: mol_type = genomic DNA

SEQ ID NO: 126963 - DNA, 252 bp, Homo sapiens; identical to SEQ ID NO: 41054
  misc_feature 1..252: note = chr7:1054444-1054696
  misc_feature 1..252: note = Hypo
  source 1..252: mol_type = genomic DNA

SEQ ID NO: 126964 - DNA, 405 bp, Homo sapiens; identical to SEQ ID NO: 96167
  misc_feature 1..405: note = chr7:1065987-1066392
  misc_feature 1..405: note = Hypo
  source 1..405: mol_type = genomic DNA

SEQ ID NO: 126965 - DNA, 30 bp, Homo sapiens; identical to SEQ ID NO: 96185
  misc_feature 1..30: note = chr7:1071811-1071841
  misc_feature 1..30: note = Hypo
  source 1..30: mol_type = genomic DNA

SEQ ID NO: 126966 - DNA, 120 bp, Homo sapiens; identical to SEQ ID NO: 96200
  misc_feature 1..120: note = chr7:1086199-1086319
  misc_feature 1..120: note = Hypo
  source 1..120: mol_type = genomic DNA

SEQ ID NO: 126967 - DNA, 279 bp, Homo sapiens; identical to SEQ ID NO: 96202
  misc_feature 1..279: note = chr7:1105515-1105794
  misc_feature 1..279: note = Hyper
  source 1..279: mol_type = genomic DNA

SEQ ID NO: 126968 - DNA, 30 bp, Homo sapiens; identical to SEQ ID NO: 41057
  misc_feature 1..30: note = chr7:1115722-1115752
  misc_feature 1..30: note = Hypo
  source 1..30: mol_type = genomic DNA

SEQ ID NO: 126969 - DNA, 331 bp, Homo sapiens; identical to SEQ ID NO: 96211
  misc_feature 1..331: note = chr7:1126502-1126833
  misc_feature 1..331: note = Hyper
  source 1..331: mol_type = genomic DNA

SEQ ID NO: 126970 - DNA, 30 bp, Homo sapiens; identical to SEQ ID NO: 96221
  misc_feature 1..30: note = chr7:1139445-1139475
  misc_feature 1..30: note = Hypo
  source 1..30: mol_type = genomic DNA

SEQ ID NO: 126971 - DNA, 155 bp, Homo sapiens; identical to SEQ ID NO: 96222
  misc_feature 1..155: note = chr7:1140555-1140710
  misc_feature 1..155: note = Hypo
  source 1..155: mol_type = genomic DNA

SEQ ID NO: 126972 - DNA, 33 bp, Homo sapiens; identical to SEQ ID NO: 96250
  misc_feature 1..33: note = chr7:1212360-1212393
  misc_feature 1..33: note = Hypo
  source 1..33: mol_type = genomic DNA

SEQ ID NO: 126973 - DNA, 30 bp, Homo sapiens; identical to SEQ ID NO: 96277
  misc_feature 1..30: note = chr7:1220695-1220725
  misc_feature 1..30: note = Hypo
  source 1..30: mol_type = genomic DNA

SEQ ID NO: 126974 - DNA, 93 bp, Homo sapiens; identical to SEQ ID NO: 96278
  misc_feature 1..93: note = chr7:1225133-1225226
  misc_feature 1..93: note = Hypo
  source 1..93: mol_type = genomic DNA

SEQ ID NO: 126975 - DNA, 30 bp, Homo sapiens; identical to SEQ ID NO: 96289
  misc_feature 1..30: note = chr7:1252449-1252479
  misc_feature 1..30: note = Hypo
  source 1..30: mol_type = genomic DNA

SEQ ID NO: 126976 - DNA, 634 bp, Homo sapiens
  misc_feature 1..634: note = chr7:1263639-1264273
  misc_feature 1..634: note = Hyper
  source 1..634: mol_type = genomic DNA
gcgcgccctgaggttcggccgctgcgtggccttctccgggaggtggggggaatccgaagaggtcccaccccaggttcggttcccggcttcctggtctttgtttaccaggctccgaggaggacctgcctctctcctcccgcagccctgggccccccactcgacagtttcacatccagggagggacaaagggggacgcggccggattagctttcgcagcgcgcggtgcgttcccggggtgcagctgcttcggggcccctgccaaggctccggcttctgcaggcgggactcgggctcgggccaccaccgcgagcactttcctggccagctccgttcccgccccatcgggccgggccgggccgagctgagcggggcgcggagaccgcggcggacggtggggagagcgcgcgcgcgtccatccgatttcaggcctttgttgccggagcctcgtgccgatgggttaatggggcagaagagatcggtgaagggcgacagaagcggcctttgaaagagggtgtcagcgcggggcagcgagacaaaggccaaaacacacacgggcggagagggacagatggggacgggcgagggaaaacaattaggccgcaagtgcgggggcggggcgcggctccatcgtttt

SEQ ID NO: 126977 - DNA, 490 bp, Homo sapiens; identical to SEQ ID NO: 96294
  misc_feature 1..490: note = chr7:1265078-1265568
  misc_feature 1..490: note = Hyper
  source 1..490: mol_type = genomic DNA

SEQ ID NO: 126978 - DNA, 611 bp, Homo sapiens
  misc_feature 1..611: note = chr7:1269197-1269808
  misc_feature 1..611: note = Hyper
  source 1..611: mol_type = genomic DNA
cgctccggccgcccccgacccggacccggactccgggcccccagctgggcccaagcgcaggaggccggtcctcacggtgcgcccgggaagggaagggccgagcggcctggagctgccagaggccgcggcccgggcgggggaaggggcaggcggaaggcgggccccggaggtctccggctgggccgggcgcgcgcgcctgggccctttgtctcgcgcggccgtcgggcccggggccccagccctgtgcgctcggggcgaggaggttcccggccggccgcagccccgagccgaggcgggcgcggaggatgagggggggtttaggatgcggccccgcgacccccgtccccctggaccgcgggctggaccgggccggggcgcgtccggcagcgctgagaccccccaccccgaatcaaagtagcggcggctgcgggggcggcgggtgggtgggggggagccgaggaacacggcgaggcgagcggcgtcctgaatgcgagtcgtgtgcgtcttattatcaagttaattaaagctagcatctgacaatgtcactcggctgtagaaaaagggatttaaatgcagcgtctcccaggaccgcgtgtcgagggctgcttccc

SEQ ID NO: 126979 - DNA, 674 bp, Homo sapiens; identical to SEQ ID NO: 96301
  misc_feature 1..674: note = chr7:1270100-1270774
  misc_feature 1..674: note = Hyper
  source 1..674: mol_type = genomic DNA

SEQ ID NO: 126980 - DNA, 123 bp, Homo sapiens; identical to SEQ ID NO: 96303
  misc_feature 1..123: note = chr7:1271038-1271161
  misc_feature 1..123: note = Hyper
  source 1..123: mol_type = genomic DNA

SEQ ID NO: 126981 - DNA, 1657 bp, Homo sapiens
  misc_feature 1..1657: note = chr7:1272298-1273955
  misc_feature 1..1657: note = Hyper
  source 1..1657: mol_type = genomic DNA
ccctccggctccccccgcccccagcccgtcttgttgtgacagttcctgatactgtttattgaggtgcatgtcaggtataattagcaatcgatatggaaaacgtttccctgcacccagcacgcctctgacgtcagagccgattagcgcttcttattggtcccaaattccccgggccgcggctaattatcgggagcttgatgttgataagtaaagcgccggagtgcgggcgaagcatgtgtggggctccgggtccctgtctccgccgccgccgcccgcgcctcccgccgctggcccgccccggccccggcccgcgcccccgcgccccgccaccggccccgccggccccccgcgcgagatgatggacggccgcctcctggaacacccgcatgcccagttcgggggctcgctgggcggcgtggtgggcttcccctacccgctgggccaccaccacgtgtacgagctggccgggcaccagctgcagtcggccgccgccgccgcctcggtgcccttctccatcgacggcctgctcgggggctcgtgcgccgccgccgcctcggtggtcaaccccacgccgctgctgccagccgcctgcggggtcggcggggacggccagcccttcaagctgtcaggtaggcgcggcgggcgggagggcggggaggagtgcggctgggggcgggggccctggtccggccgaggcgctggggggcccggggctggcgaaggagagccggctcctaggcggccgtctctgcgcccccccccccggatccaggcggccagcgggtagcgggagggaggggtgggggtcgggcctgggccggtggctgagccgcgctgcgtcctgtgactgcccgcagactcgggggacccggacaaggagagcccgggctgcaagcggcggcgcacccgcaccaacttcaccggctggcagctggaggagctggagaaggcgttcaacgagagccactatcccgacgtgttcatgcgcgaggcgctggcgctgcgcctagacctggtcgagtcccgagttcaggtaaagacccggcgtcgctcccggatctgccatccggaccccaggctctgggcgcgccgggacgcctttgttccaggtggcgagatatcgtccccttgccgcgggcccgcttcgcgctcgcctgctggggaagagtggaggggtgggggttctggggctcggcccctcacggacagcggggtgggtaactgccccccaaaagcctgggcggcttgagaagggccggcggcagcacccgagtcaccagaacagcggctgcgtccgaaccgggaagcggcgtggtgggttggcggaggccgggccaagtgaggtctccaggcaggggcgaggaggggaggaggggccggcttggctccgacccggaggagagagggaaggggacccccccccgcccccgcaccgcctcaaccttccgcgcgaggctctgtcacccagcctggagcgaacgagtctgtttaccttgcgcctgcaaaatattcagatggaaacatgtatttattcatcgctttgcagaagggaacagctgaggaaggggaggcagaagcttaaacagttaacacattgagaaagtgggagaaaaaaaggtgtctgaatttttaataataaccccggtctcatcttttt

SEQ ID NO: 126982 - DNA, 760 bp, Homo sapiens
  misc_feature 1..760: note = chr7:1274432-1275192
  misc_feature 1..760: note = Hyper
  source 1..760: mol_type = genomic DNA
cgttgggggagggctcggcttcatgctggagacctccccatggacaaggctccctgcgacaaggctgggcctgctattgtgcaagtctctgtgtggccgcgacaaagaatccgtattaacgcgccctcctggggagggcaggactgcccgagcttccgcggggctcagacggatttgactgtgtgtgtttggtggctggcggttgagtgagggtgtagcgctgccgtccccggatgtcctgtgtggctccccaggacaaggactgcagagaggatggaagagacgcgatgggcccagcctctccttccggcctggtggtcgcctcttgcctccccacctgccttggccggtggcccaggccaaggaccgcaggtttgggaaggctccgttggcgccctggcccagggtttgcggaaagaaggctgtgttagctgtgccctgggagggaggctgcagaggcccacccaagtacggctccccaggcccttccggacgagaagcacccatatttcccttcaagggattccgcccccacccccgaaatgtgggctttgacacagtctccaaggggccgaagacaggtgtggagggcggctgtggctcagcggtccaacggcaggatggtcagcgccaggccgggcgggctgcttagaacacgagccgtgagcggccaggaagggtgaacaggggccttgctctctagcctccggaccaggaacccgacgctctccgtccggggccagaccggccccccaagtaa

SEQ ID NO: 126983 - DNA, 1024 bp, Homo sapiens
  misc_feature 1..1024: note = chr7:1275543-1276567
  misc_feature 1..1024: note = Hyper
  source 1..1024: mol_type = genomic DNA
actcgcacccgaccacgtgcagcggcgagcccatggacccggaggagatcgcgcgcaaggagctggagaagatggagaagaagaagcgcaagcacgagaagaagctgctgaagagccagggccgccacttgcactcgcccggcggcctgtccctgcacagcgcgcccagctccgacagcgacagcggcggcggcggcctgtctccggagccgcccgagccgccgccgcccgccgccaagggccccggagcgcacgcctcgggcgccgcggggaccgcgcccgcccctcccggcgagccgcctgcacccggcacctgcgaccccgccttctacccgagccaaagaagcggcgccggcccacagccgcgcccaggtcgccctgcggacaaggacgcggcctcgtgcgggccaggggccgctgtggcggcggtggagcgcggcgccgcggggctgcccaaggccagcccattcagcgtggagagcctcctgtccgactcgccgccgcgccggaaagccgcttccaacgccgccgccgccgccgccgcggggctggacttcgcgcccgggctgccgtgcgcgccgcggaccctgatcggcaagggccacttcctcctctaccccatcacgcagccgctcggcttcctggtgccgcaggccgcgctcaagggcggcgcgggcctggagccggcgcccaaggacgcgccgcccgcgcccgccgtgccgcccgcgccgcctgcccaggccagtttcggggccttctcggggcccggcggcgccccggactcggccttcgcgcgtcgcagccccgacgccgtcgcctccccgggggccccagccccggccccggcgcctttccgggacctcgcctcggcagcggctaccgagggcggcggcggggactgcgcggacgcggggaccgccggccccgcgcccccgccgcccgcgccgtcgcccaggcccggccctcggcctcccagccccgccgaggagccggccacctgcggggttcccgagcctggcgcggc

SEQ ID NO: 126984 - DNA, 567 bp, Homo sapiens; identical to SEQ ID NO: 96318
  misc_feature 1..567: note = chr7:1276989-1277556
  misc_feature 1..567: note = Hyper
  source 1..567: mol_type = genomic DNA

SEQ ID NO: 126985 - DNA, 151 bp, Homo sapiens; identical to SEQ ID NO: 96323
  misc_feature 1..151: note = chr7:1277825-1277976
  misc_feature 1..151: note = Hyper
  source 1..151: mol_type = genomic DNA

SEQ ID NO: 126986 - DNA, 234 bp, Homo sapiens; identical to SEQ ID NO: 96326
  misc_feature 1..234: note = chr7:1278288-1278522
  misc_feature 1..234: note = Hyper
  source 1..234: mol_type = genomic DNA

SEQ ID NO: 126987 - DNA, 30 bp, Homo sapiens; identical to SEQ ID NO: 96330
  misc_feature 1..30: note = chr7:1279210-1279240
  misc_feature 1..30: note = Hyper
  source 1..30: mol_type = genomic DNA

SEQ ID NO: 126988 - DNA, 200 bp, Homo sapiens; identical to SEQ ID NO: 96332
  misc_feature 1..200: note = chr7:1279875-1280075
  misc_feature 1..200: note = Hyper
  source 1..200: mol_type = genomic DNA

SEQ ID NO: 126989 - DNA, 1250 bp, Homo sapiens; identical to SEQ ID NO: 96339
  misc_feature 1..1250: note = chr7:1280349-1281599
  misc_feature 1..1250: note = Hyper
  source 1..1250: mol_type = genomic DNA

SEQ ID NO: 126990 - DNA, 331 bp, Homo sapiens; identical to SEQ ID NO: 96343
  misc_feature 1..331: note = chr7:1281819-1282150
  misc_feature 1..331: note = Hyper
  source 1..331: mol_type = genomic DNA

SEQ ID NO: 126991 - DNA, 175 bp, Homo sapiens; identical to SEQ ID NO: 96344
  misc_feature 1..175: note = chr7:1282506-1282681
  misc_feature 1..175: note = Hyper
  source 1..175: mol_type = genomic DNA

SEQ ID NO: 126992 - DNA, 315 bp, Homo sapiens; identical to SEQ ID NO: 96348
  misc_feature 1..315: note = chr7:1283626-1283941
  misc_feature 1..315: note = Hyper
  source 1..315: mol_type = genomic DNA

SEQ ID NO: 126993 - DNA, 47 bp, Homo sapiens; identical to SEQ ID NO: 96349
  misc_feature 1..47: note = chr7:1284177-1284224
  misc_feature 1..47: note = Hyper
  source 1..47: mol_type = genomic DNA

SEQ ID NO: 126994 - DNA, 393 bp, Homo sapiens
  misc_feature 1..393: note = chr7:1286007-1286400
  misc_feature 1..393: note = Hyper
  source 1..393: mol_type = genomic DNA
tttgttcttgttatccgtgataattgcgaagttcagcctctcggaattgggccggcctggtgcctccagcgccgggcagggcgggcagaggccgggctgggaggcggaggctccgctgctccccttttttcccgttggaggcgatgtgtcgggtccggacacgacgtggagaggccaccagtccggtcctggggcggcggcggcctacagggccgggtcttccttctgcagatgccggttcgagccgcggcccgatcccgatcccgggaagaaacgctccgtggctcgcccagggttaagagccgcggtgacaacccgtttttgtttgagaagcggtgggtggaagccacgaatcccacacgacatctggggaccaaacgcccagagtctgga

SEQ ID NO: 126995 - DNA, 716 bp, Homo sapiens
  misc_feature 1..716: note = chr7:1286670-1287386
  misc_feature 1..716: note = Hyper
  source 1..716: mol_type = genomic DNA
acaaaagagtaactccggagaattagagaaaaaacccacgcaacaacaacacgagtcgggggcggggtgagcgctccggagaggcgctggtggggcggcggggcggggggtgctccgagccgagcagcccgacggacgcacccaggccagggctgcggagacccccgggcccgcgtgggagcagcgcgcggtccctccccaggaggcggtggaggccgaagggagtcgccgggtacccggctcaggccgtgtctgagcgccagggatgcgcagaaatgggagcctggccgcgcctctgcagcggccttggaggagcctctggagcgggccccgcgggcgcgtggggtgggacctgctggagacccgcaggcggcggcggccaagcagggtcaggcggttggcaccacaggtcgcgccctcggctgcagtcggggcagctccagggggccgcgtacctcccgcttcacggctacgcgtgggggcggctccgtcctggcctcaccagcctccccggagcccctgccggtccccagcctgggggctcaggggtcccgttgggcgtgtgtcccgcccgggccccggtgtggggggcgcgcagtcctcagggccgcctccctcccgcccccagcacagcgccccccagctctcagccggtccttgcggccgcgggatcccagccccagcagcgggaaactgaggcccgcagcaccgatgcg

SEQ ID NO: 126996 - DNA, 35 bp, Homo sapiens; identical to SEQ ID NO: 96373
  misc_feature 1..35: note = chr7:1287623-1287658
  misc_feature 1..35: note = Hyper
  source 1..35: mol_type = genomic DNA

SEQ ID NO: 126997 - DNA, 196 bp, Homo sapiens; identical to SEQ ID NO: 96375
  misc_feature 1..196: note = chr7:1288109-1288305
  misc_feature 1..196: note = Hyper
  source 1..196: mol_type = genomic DNA

SEQ ID NO: 126998 - DNA, 301 bp, Homo sapiens; identical to SEQ ID NO: 96378
  misc_feature 1..301: note = chr7:1288552-1288853
  misc_feature 1..301: note = Hyper
  source 1..301: mol_type = genomic DNA

SEQ ID NO: 126999 - DNA, 242 bp, Homo sapiens; identical to SEQ ID NO: 96379
  misc_feature 1..242: note = chr7:1289320-1289562
  misc_feature 1..242: note = Hyper
  source 1..242: mol_type = genomic DNA

SEQ ID NO: 127000 - DNA, 143 bp, Homo sapiens; identical to SEQ ID NO: 96399
  misc_feature 1..143: note = chr7:1303425-1303568
  misc_feature 1..143: note = Hypo
  source 1..143: mol_type = genomic DNA

SEQ ID NO: 127001 - DNA, 248 bp, Homo sapiens; identical to SEQ ID NO: 96400
  misc_feature 1..248: note = chr7:1308287-1308535
  misc_feature 1..248: note = Hypo
  source 1..248: mol_type = genomic DNA

SEQ ID NO: 127002 - DNA, 185 bp, Homo sapiens; identical to SEQ ID NO: 96401
  misc_feature 1..185: note = chr7:1309947-1310132
  misc_feature 1..185: note = Hypo
  source 1..185: mol_type = genomic DNA

SEQ ID NO: 127003 - DNA, 30 bp, Homo sapiens; identical to SEQ ID NO: 41060
  misc_feature 1..30: note = chr7:1313980-1314010
  misc_feature 1..30: note = Hypo
  source 1..30: mol_type = genomic DNA

SEQ ID NO: 127004 - DNA, 143 bp, Homo sapiens; identical to SEQ ID NO: 96412
  misc_feature 1..143: note = chr7:1315844-1315987
  misc_feature 1..143: note = Hypo
  source 1..143: mol_type = genomic DNA

SEQ ID NO: 127005 - DNA, 30 bp, Homo sapiens; identical to SEQ ID NO: 41062
  misc_feature 1..30: note = chr7:1318952-1318982
  misc_feature 1..30: note = Hypo
  source 1..30: mol_type = genomic DNA

SEQ ID NO: 127006 - DNA, 34 bp, Homo sapiens; identical to SEQ ID NO: 96424
  misc_feature 1..34: note = chr7:1325238-1325272
  misc_feature 1..34: note = Hypo
  source 1..34: mol_type = genomic DNA

SEQ ID NO: 127007 - DNA, 430 bp, Homo sapiens; identical to SEQ ID NO: 96425
  misc_feature 1..430: note = chr7:1325577-1326007
  misc_feature 1..430: note = Hypo
  source 1..430: mol_type = genomic DNA

SEQ ID NO: 127008 - DNA, 121 bp, Homo sapiens; identical to SEQ ID NO: 96426
  misc_feature 1..121: note = chr7:1328492-1328613
  misc_feature 1..121: note = Hypo
  source 1..121: mol_type = genomic DNA

SEQ ID NO: 127009 - DNA, 67 bp, Homo sapiens; identical to SEQ ID NO: 96427
  misc_feature 1..67: note = chr7:1331210-1331277
  misc_feature 1..67: note = Hypo
  source 1..67: mol_type = genomic DNA

SEQ ID NO: 127010 - DNA, 100 bp, Homo sapiens; identical to SEQ ID NO: 96428
  misc_feature 1..100: note = chr7:1333580-1333680
  misc_feature 1..100: note = Hypo
  source 1..100: mol_type = genomic DNA

SEQ ID NO: 127011 - DNA, 30 bp, Homo sapiens; identical to SEQ ID NO: 96429
  misc_feature 1..30: note = chr7:1335995-1336025
  misc_feature 1..30: note = Hypo
  source 1..30: mol_type = genomic DNA

SEQ ID NO: 127012 - DNA, 40 bp, Homo sapiens; identical to SEQ ID NO: 96431
  misc_feature 1..40: note = chr7:1339547-1339587
  misc_feature 1..40: note = Hypo
  source 1..40: mol_type = genomic DNA

SEQ ID NO: 127013 - DNA, 45 bp, Homo sapiens; identical to SEQ ID NO: 96437
  misc_feature 1..45: note = chr7:1347390-1347435
  misc_feature 1..45: note = Hypo
  source 1..45: mol_type = genomic DNA

SEQ ID NO: 127014 - DNA, 123 bp, Homo sapiens; identical to SEQ ID NO: 96444
  misc_feature 1..123: note = chr7:1351483-1351606
  misc_feature 1..123: note = Hypo
  source 1..123: mol_type = genomic DNA

SEQ ID NO: 127015 - DNA, 30 bp, Homo sapiens; identical to SEQ ID NO: 96456
  misc_feature 1..30: note = chr7:1360286-1360316
  misc_feature 1..30: note = Hypo
  source 1..30: mol_type = genomic DNA

SEQ ID NO: 127016 - DNA, 62 bp, Homo sapiens; identical to SEQ ID NO: 96458
  misc_feature 1..62: note = chr7:1363565-1363627
  misc_feature 1..62: note = Hypo
  source 1..62: mol_type = genomic DNA

SEQ ID NO: 127017 - DNA, 144 bp, Homo sapiens; identical to SEQ ID NO: 41068
  misc_feature 1..144: note = chr7:1365367-1365511
  misc_feature 1..144: note = Hypo
  source 1..144: mol_type = genomic DNA

SEQ ID NO: 127018 - DNA, 81 bp, Homo sapiens; identical to SEQ ID NO: 41069
  misc_feature 1..81: note = chr7:1368971-1369052
  misc_feature 1..81: note = Hypo
  source 1..81: mol_type = genomic DNA

SEQ ID NO: 127019 - DNA, 30 bp, Homo sapiens; identical to SEQ ID NO: 96468
  misc_feature 1..30: note = chr7:1369753-1369783
  misc_feature 1..30: note = Hypo
  source 1..30: mol_type = genomic DNA

SEQ ID NO: 127020 - DNA, 143 bp, Homo sapiens; identical to SEQ ID NO: 96480
  misc_feature 1..143: note = chr7:1384815-1384958
  misc_feature 1..143: note = Hypo
  source 1..143: mol_type = genomic DNA

SEQ ID NO: 127021 - DNA, 205 bp, Homo sapiens; identical to SEQ ID NO: 96500
  misc_feature 1..205: note = chr7:1395730-1395935
  misc_feature 1..205: note = Hypo
  source 1..205: mol_type = genomic DNA

SEQ ID NO: 127022 - DNA, 30 bp, Homo sapiens; identical to SEQ ID NO: 96503
  misc_feature 1..30: note = chr7:1397930-1397960
  misc_feature 1..30: note = Hypo
  source 1..30: mol_type = genomic DNA

SEQ ID NO: 127023 - DNA, 596 bp, Homo sapiens
  misc_feature 1..596: note = chr7:1408479-1409075
  misc_feature 1..596: note = Hyper
  source 1..596: mol_type = genomic DNA
ctgaaccccgggctgcgctctccccgcccctgcctggcgagtgcagattcccgcctattttccgacacccgcctgcagaggagtcgggcgccagatgggatcgaacccagcaaggtgagaaatccgggcggggtggcagatggggaggccttccccggggaactccaggagaggggaggacagcgagggccccgggcgcggcctctcgtgtgcccccagccgcggggcgcaggcccgcagccccccaggggcgccgcagctgtcactccgcggtgagtggcgccatccggatcggagatgggcgcggctgcatcgccccagggtaggaagctcatcttcggagaccgcgcggctccgagcgaccaggaacgccccctgcgggctgcgggcgggagcgcggaccccggcccatcccggaccccgcccaccgcggacctcacccatcctaggccccgcccatcccagacaccggcccatccctgaccccgcccgtccctagccccgcccaccaccgaccccacccctccagaccacgcctatcccaggccctgcccaccgcggaccccgcccatcctgcaccccgcccaccacggacc

SEQ ID NO: 127024 - DNA, 210 bp, Homo sapiens; identical to SEQ ID NO: 96538
  misc_feature 1..210: note = chr7:1416015-1416225
  misc_feature 1..210: note = Hypo
  source 1..210: mol_type = genomic DNA

SEQ ID NO: 127025 - DNA, 264 bp, Homo sapiens; identical to SEQ ID NO: 96539
  misc_feature 1..264: note = chr7:1423398-1423662
  misc_feature 1..264: note = Hypo
  source 1..264: mol_type = genomic DNA

SEQ ID NO: 127026 - DNA, 233 bp, Homo sapiens
  misc_feature 1..233: note = chr7:1443541-1443774
  misc_feature 1..233: note = Hyper
  source 1..233: mol_type = genomic DNA
gggtggcgcctggcccggcatccacactcctggtgagctctgtttgttttcataaccaattcaatatttaagacccggccagccgcggccgcaagctctccagctcccccttcctttgtctctgccgctccctgcaccccgcctcgcacttcctctgacaaaccgtgcgattctgatggaaaattcattagtcggctggtctctttccctcccctctccgtgttcccaggcag

SEQ ID NO: 127027 - DNA, 132 bp, Homo sapiens; identical to SEQ ID NO: 96551
  misc_feature 1..132: note = chr7:1451244-1451376
  misc_feature 1..132: note = Hypo
  source 1..132: mol_type = genomic DNA

SEQ ID NO: 127028 - DNA, 104 bp, Homo sapiens; identical to SEQ ID NO: 96552
  misc_feature 1..104: note = chr7:1452435-1452539
  misc_feature 1..104: note = Hyper
  source 1..104: mol_type = genomic DNA

SEQ ID NO: 127029 - DNA, 30 bp, Homo sapiens; identical to SEQ ID NO: 41075
  misc_feature 1..30: note = chr7:1453817-1453847
  misc_feature 1..30: note = Hypo
  source 1..30: mol_type = genomic DNA

SEQ ID NO: 127030 - DNA, 154 bp, Homo sapiens; identical to SEQ ID NO: 96558
  misc_feature 1..154: note = chr7:1458926-1459080
  misc_feature 1..154: note = Hypo
  source 1..154: mol_type = genomic DNA

SEQ ID NO: 127031 - DNA, 185 bp, Homo sapiens; identical to SEQ ID NO: 96559
  misc_feature 1..185: note = chr7:1460773-1460958
  misc_feature 1..185: note = Hypo
  source 1..185: mol_type = genomic DNA

SEQ ID NO: 127032 - DNA, 477 bp, Homo sapiens; identical to SEQ ID NO: 96608
  misc_feature 1..477: note = chr7:1503320-1503797
  misc_feature 1..477: note = Hypo
  source 1..477: mol_type = genomic DNA

SEQ ID NO: 127033 - DNA, 30 bp, Homo sapiens; identical to SEQ ID NO: 96610
  misc_feature 1..30: note = chr7:1505469-1505499
  misc_feature 1..30: note = Hypo
  source 1..30: mol_type = genomic DNA

SEQ ID NO: 127034 - DNA, 63 bp, Homo sapiens; identical to SEQ ID NO: 41080
  misc_feature 1..63: note = chr7:1516637-1516700
  misc_feature 1..63: note = Hypo
  source 1..63: mol_type = genomic DNA

SEQ ID NO: 127035 - DNA, 42 bp, Homo sapiens; identical to SEQ ID NO: 41081
  misc_feature 1..42: note = chr7:1532979-1533021
  misc_feature 1..42: note = Hypo
  source 1..42: mol_type = genomic DNA

SEQ ID NO: 127036 - DNA, 222 bp, Homo sapiens; identical to SEQ ID NO: 96712
  misc_feature 1..222: note = chr7:1547246-1547468
  misc_feature 1..222: note = Hypo
  source 1..222: mol_type = genomic DNA

SEQ ID NO: 127037 - DNA, 136 bp, Homo sapiens; identical to SEQ ID NO: 96797
  misc_feature 1..136: note = chr7:1557959-1558095
  misc_feature 1..136: note = Hypo
  source 1..136: mol_type = genomic DNA

SEQ ID NO: 127038 - DNA, 17 bp, Homo sapiens
  misc_feature 1..17: note = chr7:1596347-1596364
  misc_feature 1..17: note = Hypo
  source 1..17: mol_type = genomic DNA
atttgttttctgggccg

SEQ ID NO: 127039 - DNA, 854 bp, Homo sapiens; identical to SEQ ID NO: 97062
  misc_feature 1..854: note = chr7:1598548-1599402
  misc_feature 1..854: note = Hypo
  source 1..854: mol_type = genomic DNA

SEQ ID NO: 127040 - DNA, 316 bp, Homo sapiens; identical to SEQ ID NO: 97063
  misc_feature 1..316: note = chr7:1600538-1600854
  misc_feature 1..316: note = Hypo
  source 1..316: mol_type = genomic DNA

SEQ ID NO: 127041 - DNA, 789 bp, Homo sapiens; identical to SEQ ID NO: 97064
  misc_feature 1..789: note = chr7:1607231-1608020
  misc_feature 1..789: note = Hypo
  source 1..789: mol_type = genomic DNA

SEQ ID NO: 127042 - DNA, 78 bp, Homo sapiens; identical to SEQ ID NO: 97065
  misc_feature 1..78: note = chr7:1615015-1615093
  misc_feature 1..78: note = Hypo
  source 1..78: mol_type = genomic DNA

SEQ ID NO: 127043 - DNA, 36 bp, Homo sapiens; identical to SEQ ID NO: 97066
  misc_feature 1..36: note = chr7:1620503-1620539
  misc_feature 1..36: note = Hypo
  source 1..36: mol_type = genomic DNA

SEQ ID NO: 127044 - DNA, 40 bp, Homo sapiens; identical to SEQ ID NO: 97067
  misc_feature 1..40: note = chr7:1621494-1621534
  misc_feature 1..40: note = Hypo
  source 1..40: mol_type = genomic DNA

SEQ ID NO: 127045 - DNA, 123 bp, Homo sapiens; identical to SEQ ID NO: 97068
  misc_feature 1..123: note = chr7:1624765-1624888
  misc_feature 1..123: note = Hypo
  source 1..123: mol_type = genomic DNA

SEQ ID NO: 127046 - DNA, 266 bp, Homo sapiens
  misc_feature 1..266: note = chr7:1625802-1626068
  misc_feature 1..266: note = Hypo
  source 1..266: mol_type = genomic DNA
tcctgggagtcagcccgggtctaaacgcagctgggcatgaaggggtgccatcggatgtcgagttaggaggacgagagacctccagccccggcacccgcatgtctctttggaaaccagctttggctgcgcccctggggacactgtctgccgtggcctcccgctctcctccccggcacaggcagggggtctccctcctccaccgccactcccttggcctcgccctccccgccaggcacctggcttttccccaccgacccccccggggg

SEQ ID NO: 127047 - DNA, 30 bp, Homo sapiens; identical to SEQ ID NO: 97070
  misc_feature 1..30: note = chr7:1640689-1640719
  misc_feature 1..30: note = Hypo
  source 1..30: mol_type = genomic DNA

SEQ ID NO: 127048 - DNA, 308 bp, Homo sapiens; identical to SEQ ID NO: 97071
  misc_feature 1..308: note = chr7:1641670-1641978
  misc_feature 1..308: note = Hypo
  source 1..308: mol_type = genomic DNA

SEQ ID NO: 127049 - DNA, 30 bp, Homo sapiens; identical to SEQ ID NO: 97076
  misc_feature 1..30: note = chr7:1654887-1654917
  misc_feature 1..30: note = Hypo
  source 1..30: mol_type = genomic DNA

SEQ ID NO: 127050 - DNA, 30 bp, Homo sapiens; identical to SEQ ID NO: 97078
  misc_feature 1..30: note = chr7:1659704-1659734
  misc_feature 1..30: note = Hypo
  source 1..30: mol_type = genomic DNA

SEQ ID NO: 127051 - DNA, 136 bp, Homo sapiens; identical to SEQ ID NO: 97080
  misc_feature 1..136: note = chr7:1680137-1680273
  misc_feature 1..136: note = Hypo
  source 1..136: mol_type = genomic DNA

SEQ ID NO: 127052 - DNA, 50 bp, Homo sapiens; identical to SEQ ID NO: 97081
  misc_feature 1..50: note = chr7:1681189-1681239
  misc_feature 1..50: note = Hypo
  source 1..50: mol_type = genomic DNA

SEQ ID NO: 127053 - DNA, 100 bp, Homo sapiens; identical to SEQ ID NO: 41092
  misc_feature 1..100: note = chr7:1684968-1685068
  misc_feature 1..100: note = Hypo
  source 1..100: mol_type = genomic DNA

SEQ ID NO: 127054 - DNA, 151 bp, Homo sapiens; identical to SEQ ID NO: 97084
  misc_feature 1..151: note = chr7:1688950-1689101
  misc_feature 1..151: note = Hypo
  source 1..151: mol_type = genomic DNA

SEQ ID NO: 127055 - DNA, 279 bp, Homo sapiens; identical to SEQ ID NO: 97085
  misc_feature 1..279: note = chr7:1690421-1690700
  misc_feature 1..279: note = Hypo
  source 1..279: mol_type = genomic DNA

SEQ ID NO: 127056 - DNA, 30 bp, Homo sapiens; identical to SEQ ID NO: 97086
  misc_feature 1..30: note = chr7:1690977-1691007
  misc_feature 1..30: note = Hypo
  source 1..30: mol_type = genomic DNA

SEQ ID NO: 127057 - DNA, 242 bp, Homo sapiens; identical to SEQ ID NO: 97087
  misc_feature 1..242: note = chr7:1693830-1694072
  misc_feature 1..242: note = Hypo
  source 1..242: mol_type = genomic DNA

SEQ ID NO: 127058 - DNA, 106 bp, Homo sapiens; identical to SEQ ID NO: 97088
  misc_feature 1..106: note = chr7:1694880-1694986
  misc_feature 1..106: note = Hypo
  source 1..106: mol_type = genomic DNA

SEQ ID NO: 127059 - DNA, 1232 bp, Homo sapiens
  misc_feature 1..1232: note = chr7:1703921-1705153
  misc_feature 1..1232: note = Hyper
  source 1..1232: mol_type = genomic DNA
taagggctggacagccgcaggcaggggctccgtccttggcctccacccttcgtgtccagcaatcccgggagcaggcggcggcacttcctccatgccccggcctcaatcacggtctcagtccccccaaccccgtcctgcaggaacaagtgtggtagaggctcggggtcggagggcgggcggccgtcccgcgggctggacggagtttctgggctgcggagaggccgttggacccacgtccggacaggagccccgcgcgcccatccccggcccggccatcctcggggcgcgctgtctgcggcctcccgcgccacccccacccctgtcccgggacctcctccgggaaagacacccggggagcagccccctcccctccagtagtcccctcccctcccctctccctgccctcttgacggtgtggggctccccggccggaggggcgcggcgctggcagcggggtccagagtgtcgcgcccagcgcgcgctgggggtcccgggctccgcagctccgcacgcggccggtttgtgaagcggcgcgcgggggcttagccgggcgagggcgctcttgagcctggtttggaatttttagcccacacgaaagccgcaggctggggaaggggcgggtgggagcgggagacgccctgggaagccgtgagaccgctcggcgagggctcgggaccaccagggagcgacgggggacccctcggctcagagcccgagggcgcgatttcggatccgctgggattccggaggcacatgaagggagagggaaatccgctaaaccgaaccttccgggaatcggaaggcgccgggccgctcccacgcctccccctcctcccggccgaaaggcggggggcgacgcgcaacggggagggaagggagggaggggtcggcgaccttaggggagggcgagtctctggggacgcggggccgccaggggcccgacgaccctctcgctccacctccccgcccccaagtgccccgctctccccccgccccgcaaacgcgcgtcctgcgggctgtgctttggccctcgcggacgcgcgcgctcacagagggtctgacttggggtcaacttccacgaggttgccgggcgcctgtgagcacagccgtgtccccacccaggggcccacctcccagcgccaccagggtcccgacccccagaccttcggacgcttctcttccaaaccgaagcctgggagcctctgggtggcctggggcgggggcagggggcg

SEQ ID NO: 127060 - DNA, 307 bp, Homo sapiens; identical to SEQ ID NO: 97090
  misc_feature 1..307: note = chr7:1705386-1705693
  misc_feature 1..307: note = Hyper
  source 1..307: mol_type = genomic DNA

SEQ ID NO: 127061 - DNA, 538 bp, Homo sapiens; identical to SEQ ID NO: 97091
  misc_feature 1..538: note = chr7:1706195-1706733
  misc_feature 1..538: note = Hyper
  source 1..538: mol_type = genomic DNA

SEQ ID NO: 127062 - DNA, 370 bp, Homo sapiens; identical to SEQ ID NO: 97092
  misc_feature 1..370: note = chr7:1706939-1707309
  misc_feature 1..370: note = Hyper
  source 1..370: mol_type = genomic DNA

SEQ ID NO: 127063 - DNA, 1310 bp, Homo sapiens
  misc_feature 1..1310: note = chr7:1709060-1710370
  misc_feature 1..1310: note = Hyper
  source 1..1310: mol_type = genomic DNA
ggcttgtccaggcaccgccggggcctgcccggcccgagcgtggagtcccgaggctcctgccgggggtccaggctgcccctggggctctgccttcgacgcgctgtgtagggccagattctgggcctctcttgactcagtttcccttcctgtaacatgcggacgggggcttccgcacaggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgcttgaggtggtgggagtcgcgggtagcttgttcagccaacagctgtcgcccccactccccccacccacccacccaccccctccaccttttagatgtgggcggggagggccggggacggaccgcgaggacgccccctgcgctttctaggacctcccctccttccccagcccctgcgcgtcgccgggagagggaaggagcgggttgccgcggggagccgaggagagcagggggctcgggaggccagggagagaaggggagggccagaggctccgagccggactcgcggcggaggaagagggggtggaagggagcgcgcaggcgggcgagggagcgagggagggagagaaggagggagggagggagggaaggggggcgggagggggcagggcgagcttgaattcccccccggccgcgcggcgaggggcggggccgcgcgcgcagatcgatgggcgaagctggggaggaatttcaatcccgggagcgaagttagagcttgaaggacggcggcggctgcgggcgcagccccggaaccgaggccgggcgggcaggtaagcggcgagcgcggccgggcgctgaacctgggggacttgggacccggaccacccccggggagcggcgcggccaagccccccgccacctcgaaccccgggcgtccccgagtgcgcagcgtgcgcccccagcccctgctgcgcccccaggcctggcgcgcgatccgagcgcagcgggcaaagttggaggaacttggcggcggcggagcgggcgcaggctcagcccgacaaagcccgggggcccgggtcggggtcgctgccgcagcccgcacgctgccccgtgcctccgagaggtcccttccccagcgcctctctcccttccgtcccccttcgccgtccgcaccctgcccggcgccccccagacgcggccccctgccctt

SEQ ID NO: 127064 - DNA, 76 bp, Homo sapiens; identical to SEQ ID NO: 97097
  misc_feature 1..76: note = chr7:1712668-1712744
  misc_feature 1..76: note = Hypo
  source 1..76: mol_type = genomic DNA

SEQ ID NO: 127065 - DNA, 50 bp, Homo sapiens; identical to SEQ ID NO: 41096
  misc_feature 1..50: note = chr7:1714947-1714997
  misc_feature 1..50: note = Hypo
  source 1..50: mol_type = genomic DNA

SEQ ID NO: 127066 - DNA, 178 bp, Homo sapiens; identical to SEQ ID NO: 97100
  misc_feature 1..178: note = chr7:1717985-1718163
  misc_feature 1..178: note = Hypo
  source 1..178: mol_type = genomic DNA

SEQ ID NO: 127067 - DNA, 158 bp, Homo sapiens; identical to SEQ ID NO: 97101
  misc_feature 1..158: note = chr7:1719538-1719696
  misc_feature 1..158: note = Hypo
  source 1..158: mol_type = genomic DNA

SEQ ID NO: 127068 - DNA, 206 bp, Homo sapiens; identical to SEQ ID NO: 41098
  misc_feature 1..206: note = chr7:1731744-1731950
  misc_feature 1..206: note = Hypo
  source 1..206: mol_type = genomic DNA

SEQ ID NO: 127069 - DNA, 278 bp, Homo sapiens; identical to SEQ ID NO: 97103
  misc_feature 1..278: note = chr7:1733166-1733444
  misc_feature 1..278: note = Hypo
  source 1..278: mol_type = genomic DNA

SEQ ID NO: 127070 - DNA, 366 bp, Homo sapiens; identical to SEQ ID NO: 97106
  misc_feature 1..366: note = chr7:1734686-1735052
  misc_feature 1..366: note = Hypo
  source 1..366: mol_type = genomic DNA

SEQ ID NO: 127071 - DNA, 174 bp, Homo sapiens; identical to SEQ ID NO: 97108
  misc_feature 1..174: note = chr7:1744404-1744578
  misc_feature 1..174: note = Hypo
  source 1..174: mol_type = genomic DNA

SEQ ID NO: 127072 - DNA, 558 bp, Homo sapiens; identical to SEQ ID NO: 97109
  misc_feature 1..558: note = chr7:1775495-1776053
  misc_feature 1..558: note = Hypo
  source 1..558: mol_type = genomic DNA

SEQ ID NO: 127073 - DNA, 30 bp, Homo sapiens; identical to SEQ ID NO: 97110
  misc_feature 1..30: note = chr7:1777547-1777577
  misc_feature 1..30: note = Hypo
  source 1..30: mol_type = genomic DNA

SEQ ID NO: 127074 - DNA, 51 bp, Homo sapiens; identical to SEQ ID NO: 97111
  misc_feature 1..51: note = chr7:1779654-1779705
  misc_feature 1..51: note = Hypo
  source 1..51: mol_type = genomic DNA

SEQ ID NO: 127075 - DNA, 192 bp, Homo sapiens; identical to SEQ ID NO: 97112
  misc_feature 1..192: note = chr7:1783194-1783386
  misc_feature 1..192: note = Hypo
  source 1..192: mol_type = genomic DNA

SEQ ID NO: 127076 - DNA, 231 bp, Homo sapiens; identical to SEQ ID NO: 97113
  misc_feature 1..231: note = chr7:1784226-1784457
  misc_feature 1..231: note = Hypo
  source 1..231: mol_type = genomic DNA

SEQ ID NO: 127077 - DNA, 237 bp, Homo sapiens; identical to SEQ ID NO: 97114
  misc_feature 1..237: note = chr7:1784690-1784927
  misc_feature 1..237: note = Hypo
  source 1..237: mol_type = genomic DNA

SEQ ID NO: 127078 - DNA, 506 bp, Homo sapiens; identical to SEQ ID NO: 97115
  misc_feature 1..506: note = chr7:1786393-1786899
  misc_feature 1..506: note = Hypo
  source 1..506: mol_type = genomic DNA

SEQ ID NO: 127079 - DNA, 282 bp, Homo sapiens; identical to SEQ ID NO: 97116
  misc_feature 1..282: note = chr7:1787137-1787419
  misc_feature 1..282: note = Hypo
  source 1..282: mol_type = genomic DNA

SEQ ID NO: 127080 - DNA, 30 bp, Homo sapiens; identical to SEQ ID NO: 97117
  misc_feature 1..30: note = chr7:1790379-1790409
  misc_feature 1..30: note = Hypo
  source 1..30: mol_type = genomic DNA

SEQ ID NO: 127081 - DNA, 73 bp, Homo sapiens; identical to SEQ ID NO: 97118
  misc_feature 1..73: note = chr7:1795137-1795210
  misc_feature 1..73: note = Hypo
  source 1..73: mol_type = genomic DNA

SEQ ID NO: 127082 - DNA, 30 bp, Homo sapiens; identical to SEQ ID NO: 97119
  misc_feature 1..30: note = chr7:1797456-1797486
  misc_feature 1..30: note = Hypo
  source 1..30: mol_type = genomic DNA

SEQ ID NO: 127083 - DNA, 30 bp, Homo sapiens; identical to SEQ ID NO: 97120
  misc_feature 1..30: note = chr7:1798877-1798907
  misc_feature 1..30: note = Hypo
  source 1..30: mol_type = genomic DNA

SEQ ID NO: 127084 - DNA, 91 bp, Homo sapiens; identical to SEQ ID NO: 97121
  misc_feature 1..91: note = chr7:1800821-1800912
  misc_feature 1..91: note = Hypo
  source 1..91: mol_type = genomic DNA

SEQ ID NO: 127085 - DNA, 30 bp, Homo sapiens; identical to SEQ ID NO: 97126
  misc_feature 1..30: note = chr7:1819163-1819193
  misc_feature 1..30: note = Hypo
  source 1..30: mol_type = genomic DNA

SEQ ID NO: 127086 - DNA, 79 bp, Homo sapiens; identical to SEQ ID NO: 97127
  misc_feature 1..79: note = chr7:1838908-1838987
  misc_feature 1..79: note = Hypo
  source 1..79: mol_type = genomic DNA

SEQ ID NO: 127087 - DNA, 49 bp, Homo sapiens; identical to SEQ ID NO: 97128
  misc_feature 1..49: note = chr7:1849747-1849796
  misc_feature 1..49: note = Hypo
  source 1..49: mol_type = genomic DNA

SEQ ID NO: 127088 - DNA, 40 bp, Homo sapiens; identical to SEQ ID NO: 97130
  misc_feature 1..40: note = chr7:1879361-1879401
  misc_feature 1..40: note = Hypo
  source 1..40: mol_type = genomic DNA

SEQ ID NO: 127089 - DNA, 30 bp, Homo sapiens; identical to SEQ ID NO: 97131
  misc_feature 1..30: note = chr7:1883040-1883070
  misc_feature 1..30: note = Hypo
  source 1..30: mol_type = genomic DNA

SEQ ID NO: 127090 - DNA, 30 bp, Homo sapiens; identical to SEQ ID NO: 97132
  misc_feature 1..30: note = chr7:1888859-1888889
  misc_feature 1..30: note = Hypo
  source 1..30: mol_type = genomic DNA

SEQ ID NO: 127091 - DNA, 30 bp, Homo sapiens; identical to SEQ ID NO: 97133
  misc_feature 1..30: note = chr7:1913796-1913826
  misc_feature 1..30: note = Hypo
  source 1..30: mol_type = genomic DNA

SEQ ID NO: 127092 - DNA, 104 bp, Homo sapiens; identical to SEQ ID NO: 97154
  misc_feature 1..104: note = chr7:1931869-1931973
  misc_feature 1..104: note = Hypo
  source 1..104: mol_type = genomic DNA

SEQ ID NO: 127093 - DNA, 150 bp, Homo sapiens; identical to SEQ ID NO: 97157
  misc_feature 1..150: note = chr7:1962361-1962511
  misc_feature 1..150: note = Hypo
  source 1..150: mol_type = genomic DNA

SEQ ID NO: 127094 - DNA, 52 bp, Homo sapiens; identical to SEQ ID NO: 97158
  misc_feature 1..52: note = chr7:1970869-1970921
  misc_feature 1..52: note = Hypo
  source 1..52: mol_type = genomic DNA

SEQ ID NO: 127095 - DNA, 30 bp, Homo sapiens; identical to SEQ ID NO: 41114
  misc_feature 1..30: note = chr7:2024812-2024842
  misc_feature 1..30: note = Hypo
  source 1..30: mol_type = genomic DNA

SEQ ID NO: 127096 - DNA, 35 bp, Homo sapiens; identical to SEQ ID NO: 97161
  misc_feature 1..35: note = chr7:2037950-2037985
  misc_feature 1..35: note = Hypo
  source 1..35: mol_type = genomic DNA

SEQ ID NO: 127097 - DNA, 132 bp, Homo sapiens; identical to SEQ ID NO: 97162
  misc_feature 1..132: note = chr7:2056554-2056686
  misc_feature 1..132: note = Hypo
  source 1..132: mol_type = genomic DNA

SEQ ID NO: 127098 - DNA, 114 bp, Homo sapiens; identical to SEQ ID NO: 97191
  misc_feature 1..114: note = chr7:2110154-2110268
  misc_feature 1..114: note = Hypo
  source 1..114: mol_type = genomic DNA

SEQ ID NO: 127099 - DNA, 30 bp, Homo sapiens; identical to SEQ ID NO: 97192
  misc_feature 1..30: note = chr7:2120265-2120295
  misc_feature 1..30: note = Hypo
  source 1..30: mol_type = genomic DNA

SEQ ID NO: 127100 - DNA, 103 bp, Homo sapiens; identical to SEQ ID NO: 97198
  misc_feature 1..103: note = chr7:2163294-2163397
  misc_feature 1..103: note = Hypo
  source 1..103: mol_type = genomic DNA

SEQ ID NO: 127101 - DNA, 30 bp, Homo sapiens; identical to SEQ ID NO: 97200
  misc_feature 1..30: note = chr7:2197210-2197240
  misc_feature 1..30: note = Hypo
  source 1..30: mol_type = genomic DNA

SEQ ID NO: 127102 - DNA, 317 bp, Homo sapiens; identical to SEQ ID NO: 97201
  misc_feature 1..317: note = chr7:2206439-2206756
  misc_feature 1..317: note = Hypo
  source 1..317: mol_type = genomic DNA

SEQ ID NO: 127103 - DNA, 120 bp, Homo sapiens; identical to SEQ ID NO: 97202
  misc_feature 1..120: note = chr7:2208724-2208844
  misc_feature 1..120: note = Hypo
  source 1..120: mol_type = genomic DNA

SEQ ID NO: 127104 - DNA, 165 bp, Homo sapiens; identical to SEQ ID NO: 97203
  misc_feature 1..165: note = chr7:2232891-2233056
  misc_feature 1..165: note = Hypo
  source 1..165: mol_type = genomic DNA

SEQ ID NO: 127105 - DNA, 178 bp, Homo sapiens; identical to SEQ ID NO: 97204
  misc_feature 1..178: note = chr7:2233292-2233470
  misc_feature 1..178: note = Hypo
  source 1..178: mol_type = genomic DNA

SEQ ID NO: 127106 - DNA, 154 bp, Homo sapiens; identical to SEQ ID NO: 41122
  misc_feature 1..154: note = chr7:2238153-2238307
  misc_feature 1..154: note = Hypo
  source 1..154: mol_type = genomic DNA

SEQ ID NO: 127107 - DNA, 230 bp, Homo sapiens; identical to SEQ ID NO: 97209
  misc_feature 1..230: note = chr7:2265011-2265241
  misc_feature 1..230: note = Hypo
  source 1..230: mol_type = genomic DNA

SEQ ID NO: 127108 - DNA, 85 bp, Homo sapiens; identical to SEQ ID NO: 41123
  misc_feature 1..85: note = chr7:2265530-2265615
  misc_feature 1..85: note = Hypo
  source 1..85: mol_type = genomic DNA

SEQ ID NO: 127109 - DNA, 16 bp, Homo sapiens
  misc_feature 1..16: note = chr7:2300787-2300803
  misc_feature 1..16: note = Hypo
  source 1..16: mol_type = genomic DNA
ctgggcacagaggctc

SEQ ID NO: 127110 - DNA, 79 bp, Homo sapiens; identical to SEQ ID NO: 97222
  misc_feature 1..79: note = chr7:2349353-2349432
  misc_feature 1..79: note = Hypo
  source 1..79: mol_type = genomic DNA

SEQ ID NO: 127111 - DNA, 83 bp, Homo sapiens; identical to SEQ ID NO: 41126
  misc_feature 1..83: note = chr7:2420313-2420396
  misc_feature 1..83: note = Hypo
  source 1..83: mol_type = genomic DNA

SEQ ID NO: 127112 - DNA, 161 bp, Homo sapiens; identical to SEQ ID NO: 97238
  misc_feature 1..161: note = chr7:2436226-2436387
  misc_feature 1..161: note = Hypo
  source 1..161: mol_type = genomic DNA

SEQ ID NO: 127113 - DNA, 216 bp, Homo sapiens
  misc_feature 1..216: note = chr7:2473296-2473512
  misc_feature 1..216: note = Hypo
  source 1..216: mol_type = genomic DNA
gctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccg

SEQ ID NO: 127114 - DNA, 42 bp, Homo sapiens
  misc_feature 1..42: note = chr7:2473722-2473764
  misc_feature 1..42: note = Hypo
  source 1..42: mol_type = genomic DNA
atcccctctcccctccgcccgcccacccgcccgcccgctcgc

SEQ ID NO: 127115 - DNA, 30 bp, Homo sapiens; identical to SEQ ID NO: 97243
  misc_feature 1..30: note = chr7:2477693-2477723
  misc_feature 1..30: note = Hypo
  source 1..30: mol_type = genomic DNA

SEQ ID NO: 127116 - DNA, 157 bp, Homo sapiens; identical to SEQ ID NO: 97247
  misc_feature 1..157: note = chr7:2480354-2480511
  misc_feature 1..157: note = Hypo
  source 1..157: mol_type = genomic DNA

SEQ ID NO: 127117 - DNA, 30 bp, Homo sapiens; identical to SEQ ID NO: 97248
  misc_feature 1..30: note = chr7:2480719-2480749
  misc_feature 1..30: note = Hypo
  source 1..30: mol_type = genomic DNA

SEQ ID NO: 127118 - DNA, 37 bp, Homo sapiens; identical to SEQ ID NO: 97250
  misc_feature 1..37: note = chr7:2499681-2499718
  misc_feature 1..37: note = Hypo
  source 1..37: mol_type = genomic DNA

SEQ ID NO: 127119 - DNA, 47 bp, Homo sapiens; identical to SEQ ID NO: 97254
  misc_feature 1..47: note = chr7:2515514-2515561
  misc_feature 1..47: note = Hypo
  source 1..47: mol_type = genomic DNA

SEQ ID NO: 127120 - DNA, 164 bp, Homo sapiens; identical to SEQ ID NO: 97257
  misc_feature 1..164: note = chr7:2544463-2544627
  misc_feature 1..164: note = Hypo
  source 1..164: mol_type = genomic DNA

SEQ ID NO: 127121 - DNA, 33 bp, Homo sapiens; identical to SEQ ID NO: 97259
  misc_feature 1..33: note = chr7:2551467-2551500
  misc_feature 1..33: note = Hyper
  source 1..33: mol_type = genomic DNA

SEQ ID NO: 127122 - DNA, 109 bp, Homo sapiens
  misc_feature 1..109: note = chr7:2558415-2558524
  misc_feature 1..109: note = Hyper
  source 1..109: mol_type = genomic DNA
ttccggaggacgtggcgggcagggggctcacaccctgctcaggcgacccttggccacttccgggcccctcgcccctcaccctcggctgccggcgcgcattcctgccgcc

SEQ ID NO: 127123 - DNA, 89 bp, Homo sapiens; identical to SEQ ID NO: 97264
  misc_feature 1..89: note = chr7:2560970-2561059
  misc_feature 1..89: note = Hyper
  source 1..89: mol_type = genomic DNA

SEQ ID NO: 127124 - DNA, 438 bp, Homo sapiens; identical to SEQ ID NO: 97265
  misc_feature 1..438: note = chr7:2564642-2565080
  misc_feature 1..438: note = Hypo
  source 1..438: mol_type = genomic DNA

SEQ ID NO: 127125 - DNA, 617 bp, Homo sapiens; identical to SEQ ID NO: 97266
  misc_feature 1..617: note = chr7:2566041-2566658
  misc_feature 1..617: note = Hypo
  source 1..617: mol_type = genomic DNA

SEQ ID NO: 127126 - DNA, 44 bp, Homo sapiens; identical to SEQ ID NO: 97267
  misc_feature 1..44: note = chr7:2566895-2566939
  misc_feature 1..44: note = Hypo
  source 1..44: mol_type = genomic DNA

SEQ ID NO: 127127 - DNA, 30 bp, Homo sapiens; identical to SEQ ID NO: 97275
  misc_feature 1..30: note = chr7:2612457-2612487
  misc_feature 1..30: note = Hypo
  source 1..30: mol_type = genomic DNA

SEQ ID NO: 127128 - DNA, 55 bp, Homo sapiens; identical to SEQ ID NO: 97284
  misc_feature 1..55: note = chr7:2652597-2652652
  misc_feature 1..55: note = Hypo
  source 1..55: mol_type = genomic DNA

SEQ ID NO: 127129 - DNA, 35 bp, Homo sapiens; identical to SEQ ID NO: 97286
  misc_feature 1..35: note = chr7:2658370-2658405
  misc_feature 1..35: note = Hypo
  source 1..35: mol_type = genomic DNA

SEQ ID NO: 127130 - DNA, 463 bp, Homo sapiens; identical to SEQ ID NO: 97289
  misc_feature 1..463: note = chr7:2686448-2686911
  misc_feature 1..463: note = Hypo
  source 1..463: mol_type = genomic DNA

SEQ ID NO: 127131 - DNA, 62 bp, Homo sapiens; identical to SEQ ID NO: 97291
  misc_feature 1..62: note = chr7:2700087-2700149
  misc_feature 1..62: note = Hypo
  source 1..62: mol_type = genomic DNA

SEQ ID NO: 127132 - DNA, 203 bp, Homo sapiens; identical to SEQ ID NO: 97296
  misc_feature 1..203: note = chr7:2718466-2718669
  misc_feature 1..203: note = Hypo
  source 1..203: mol_type = genomic DNA

SEQ ID NO: 127133 - DNA, 127 bp, Homo sapiens; identical to SEQ ID NO: 97304
  misc_feature 1..127: note = chr7:2720013-2720140
  misc_feature 1..127: note = Hypo
  source 1..127: mol_type = genomic DNA

SEQ ID NO: 127134 - DNA, 440 bp, Homo sapiens
  misc_feature 1..440: note = chr7:2727819-2728259
  misc_feature 1..440: note = Hyper
  source 1..440: mol_type = genomic DNA
gtcaccgggacctcccgatcctcccggcccaggccgagctgcccacgctgctgcccggggctcggtgcccggcgcggcctctgccggctccggcgggcgcgggactgcgaggtaggggggcgcgcggggaagactcgggggcgcagggaccgagagggacctccgtgccggggcgggtgggtaggggcagctccgggtccagcccggcccgcgcaccaagtcccgagggcgcccgggcggcggcggctacgggcgcgcggggaccgcggagacgcgaagggcgcacttggcgagggtttggtgcagcgccgcgccggggtccgcacagccccggcaggtcctgcagagggaaggccgggccagggaagggccacgcgccccctccccgccatcctctcccaggccagggcgacctgcgcgcttcccgatgggagcaaact

SEQ ID NO: 127135 - DNA, 17 bp, Homo sapiens
  misc_feature 1..17: note = chr7:2731870-2731887
  misc_feature 1..17: note = Hypo
  source 1..17: mol_type = genomic DNA
gggttgaaagaggaccg

SEQ ID NO: 127136 - DNA, 98 bp, Homo sapiens; identical to SEQ ID NO: 97350
  misc_feature 1..98: note = chr7:2747103-2747201
  misc_feature 1..98: note = Hypo
  source 1..98: mol_type = genomic DNA

SEQ ID NO: 127137 - DNA, 30 bp, Homo sapiens; identical to SEQ ID NO: 97355
  misc_feature 1..30: note = chr7:2770610-2770640
  misc_feature 1..30: note = Hypo
  source 1..30: mol_type = genomic DNA

SEQ ID NO: 127138 - DNA, 80 bp, Homo sapiens; identical to SEQ ID NO: 97361
  misc_feature 1..80: note = chr7:2798456-2798536
  misc_feature 1..80: note = Hypo
  source 1..80: mol_type = genomic DNA

SEQ ID NO: 127139 - DNA, 75 bp, Homo sapiens; identical to SEQ ID NO: 97377
  misc_feature 1..75: note = chr7:2864022-2864097
  misc_feature 1..75: note = Hypo
  source 1..75: mol_type = genomic DNA

SEQ ID NO: 127140 - DNA, 164 bp, Homo sapiens; identical to SEQ ID NO: 97388
  misc_feature 1..164: note = chr7:2900214-2900378
  misc_feature 1..164: note = Hypo
  source 1..164: mol_type = genomic DNA

SEQ ID NO: 127141 - DNA, 44 bp, Homo sapiens; identical to SEQ ID NO: 97389
  misc_feature 1..44: note = chr7:2916072-2916116
  misc_feature 1..44: note = Hypo
  source 1..44: mol_type = genomic DNA

SEQ ID NO: 127142 - DNA, 30 bp, Homo sapiens; identical to SEQ ID NO: 97391
  misc_feature 1..30: note = chr7:2920175-2920205
  misc_feature 1..30: note = Hypo
  source 1..30: mol_type = genomic DNA

SEQ ID NO: 127143 - DNA, 206 bp, Homo sapiens; identical to SEQ ID NO: 97393
  misc_feature 1..206: note = chr7:2923723-2923929
  misc_feature 1..206: note = Hypo
  source 1..206: mol_type = genomic DNA

SEQ ID NO: 127144 - DNA, 30 bp, Homo sapiens; identical to SEQ ID NO: 97395
  misc_feature 1..30: note = chr7:2946546-2946576
  misc_feature 1..30: note = Hypo
  source 1..30: mol_type = genomic DNA

SEQ ID NO: 127145 - DNA, 34 bp, Homo sapiens; identical to SEQ ID NO: 97397
  misc_feature 1..34: note = chr7:2950000-2950034
  misc_feature 1..34: note = Hypo
  source 1..34: mol_type = genomic DNA

SEQ ID NO: 127146 - DNA, 30 bp, Homo sapiens; identical to SEQ ID NO: 97398
  misc_feature 1..30: note = chr7:2954959-2954989
  misc_feature 1..30: note = Hypo
  source 1..30: mol_type = genomic DNA

SEQ ID NO: 127147 - DNA, 30 bp, Homo sapiens; identical to SEQ ID NO: 97399
  misc_feature 1..30: note = chr7:2958214-2958244
  misc_feature 1..30: note = Hypo
  source 1..30: mol_type = genomic DNA

SEQ ID NO: 127148 - DNA, 30 bp, Homo sapiens; identical to SEQ ID NO: 41142
  misc_feature 1..30: note = chr7:2958507-2958537
  misc_feature 1..30: note = Hypo
  source 1..30: mol_type = genomic DNA

SEQ ID NO: 127149 - DNA, 203 bp, Homo sapiens; identical to SEQ ID NO: 97402
  misc_feature 1..203: note = chr7:2960538-2960741
  misc_feature 1..203: note = Hypo
  source 1..203: mol_type = genomic DNA

SEQ ID NO: 127150 - DNA, 30 bp, Homo sapiens; identical to SEQ ID NO: 97403
  misc_feature 1..30: note = chr7:2961827-2961857
  misc_feature 1..30: note = Hypo
  source 1..30: mol_type = genomic DNA

SEQ ID NO: 127151 - DNA, 34 bp, Homo sapiens; identical to SEQ ID NO: 97404
  misc_feature 1..34: note = chr7:2963968-2964002
  misc_feature 1..34: note = Hypo
  source 1..34: mol_type = genomic DNA

SEQ ID NO: 127152 - DNA, 73 bp, Homo sapiens; identical to SEQ ID NO: 41143
  misc_feature 1..73: note = chr7:2966469-2966542
  misc_feature 1..73: note = Hypo
  source 1..73: mol_type = genomic DNA

SEQ ID NO: 127153 - DNA, 160 bp, Homo sapiens; identical to SEQ ID NO: 97407
  misc_feature 1..160: note = chr7:2972398-2972558
  misc_feature 1..160: note = Hypo
  source 1..160: mol_type = genomic DNA

SEQ ID NO: 127154 - DNA, 63 bp, Homo sapiens; identical to SEQ ID NO: 97409
  misc_feature 1..63: note = chr7:2976839-2976902
  misc_feature 1..63: note = Hypo
  source 1..63: mol_type = genomic DNA

SEQ ID NO: 127155 - DNA, 173 bp, Homo sapiens; identical to SEQ ID NO: 97421
  misc_feature 1..173: note = chr7:3026166-3026339
  misc_feature 1..173: note = Hypo
  source 1..173: mol_type = genomic DNA

SEQ ID NO: 127156 - DNA, 321 bp, Homo sapiens; identical to SEQ ID NO: 41146
  misc_feature 1..321: note = chr7:3033477-3033798
  misc_feature 1..321: note = Hypo
  source 1..321: mol_type = genomic DNA

SEQ ID NO: 127157 - DNA, 30 bp, Homo sapiens; identical to SEQ ID NO: 97424
  misc_feature 1..30: note = chr7:3044096-3044126
  misc_feature 1..30: note = Hypo
  source 1..30: mol_type = genomic DNA

SEQ ID NO: 127158 - DNA, 59 bp, Homo sapiens; identical to SEQ ID NO: 97425
  misc_feature 1..59: note = chr7:3052608-3052667
  misc_feature 1..59: note = Hypo
  source 1..59: mol_type = genomic DNA

SEQ ID NO: 127159 - DNA, 30 bp, Homo sapiens; identical to SEQ ID NO: 97434
  misc_feature 1..30: note = chr7:3074446-3074476
  misc_feature 1..30: note = Hypo
  source 1..30: mol_type = genomic DNA

SEQ ID NO: 127160 - DNA, 476 bp, Homo sapiens
  misc_feature 1..476: note = chr7:3083126-3083602
  misc_feature 1..476: note = Hyper
  source 1..476: mol_type = genomic DNA
ggatacccccagcatcgcgggaccagcgggagccactcccatcccccgacgccccccccgccaccgtgtcatctcactgatgccccccatctcctccccgtgccctcttctcttcccccaactccccgcctcgtgctccccctccgccagctcccccatccccgctgcgcctacctggggcgctcatgctccgccagccagctgcgcggggcgcctcctccacgcaggcctccggcttcctccaggcgaccaggccctccgtccccccgggcccggagccgtcctccgaggggcgccgcccgcccaggggctgcagggccgggagggggctgcgggcggcgcgggcaggagtccgaaggccagaggaggcaggagagaaaaaaggagagaaagtatgtcataggctgggaggggcgggggagggaaatgcaaaacccgacaggaaatgagactaaaaaatgcgaaaggttagaaaa

SEQ ID NO: 127161 - DNA, 396 bp, Homo sapiens; identical to SEQ ID NO: 41147
  misc_feature 1..396: note = chr7:3283498-3283894
  misc_feature 1..396: note = Hypo
  source 1..396: mol_type = genomic DNA

SEQ ID NO: 127162 - DNA, 25 bp, Homo sapiens
  misc_feature 1..25: note = chr7:3287058-3287083
  misc_feature 1..25: note = Hypo
  source 1..25: mol_type = genomic DNA
aatagggccaggcaccgtggctcac

SEQ ID NO: 127163 - DNA, 2353 bp, Homo sapiens
  misc_feature 1..2353: note = chr7:3339931-3342284
  misc_feature 1..2353: note = Hyper
  source 1..2353: mol_type = genomic DNA
ttacatgatctcatgcgaccatcatcacacgtccccaggctcctcccgggccaactccagaggcagtgcgtgtcacctccagctctcctcccacaaaaatgctggcctttcagcctccagtgcgcttagttcaccccataaactctgctaatgcttaccacatgctgagcgtcggcgcccgtccccacccccagccccacaggctcccgggtcccgccctgggagaccctcccactggccgaccctgccccaagactcgcccactccacggtgggaaacctgcaatgtgtccctccctaccccgccctcctccagcgccggccaaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcgccctattccgccctcggccctgggctgccgcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtccccactacgggtccctagggggcgcagccggcgcgggaagccgcccgagccaggcgccgcggccggcacaaaattgcaggcgggcgggcgccgcgactttgaaaacaagcgagggcctggggggcgggccctgggagcgggcgccgcctccctcggccaatcaacggcgggcggcgggcggcgggcgcgggcggcgcgtgcggccgggctgtgaatggggagcggcggccgcggcagctgagggcgagcgcgaccgcgacgtgcgggcgggcgcactttcttctcagcgccgggcgggggcggcggcggcggcggctcctccgcgcccggcggacccctcggagctagcgcggcgggctcgggactgcgtgagcgccggacgcgaatttcccccgttgacaacttcttctcgcccggctcgtccccggcccgcgccgcgcccctcacgcggggacccaggacgccgcccctcagcgctgggcggccgctcacctcgggccggggggcgccgcgcctcccgcggagtggccgcgcccgctcggagccgtcccgcctgtcctgcccgcccgtccgtccggcgcggcgctcggggtggcggctgctcggcatggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaaggtaggtgcgcgcggggtcgcgggccgggggcgtcgcctcggggcgcggaggcgcgaacttgagcagcgagagtgtgtccggggtccccccgcttcccggcccgggtcgggatgcgccttgctgggggctctagggagcccaggggctcctccacgccagactcggaggagagggaaacggagccccgtagagcctgcaccccgtctgctactttgcgttttattttttttataccgcagtagcacaaacaaaaatttttaagttgaggacccatttctcagctccttaaaaggatgcccgagtccccttcccattgcatggatgaaaaaggggctggtctgtacctgagtcttcgcaccgcagggtctggtttccggtgagtgacatccagaagacttggaaatatcaagtgccagtcgctgtgaaaagccttttccagcccctccccagggcctcgtcctctccccagcccccgcctgctcctgactcccccaagtcccaaagcccgaccccaagtgggtgctgcgcggccggtggagcaaaactttcagtgcccacagcttttgcacttggctttgtttttctccctctattggcttctgtttagaatacagtggtgagctctgaaatagggaaagaggatctgctgaatggaaatgaccttttgaaacgagagatgggatctcttgtgaaacgagctttccttcccaaatctgggcttccctccaccccctccccgcccccgacaaaacccgtaacgtacccctg

SEQ ID NO: 127164 - DNA, 38 bp, Homo sapiens; identical to SEQ ID NO: 41148
  misc_feature 1..38: note = chr7:3727142-3727180
  misc_feature 1..38: note = Hypo
  source 1..38: mol_type = genomic DNA

SEQ ID NO: 127165 - DNA, 33 bp, Homo sapiens; identical to SEQ ID NO: 97535
  misc_feature 1..33: note = chr7:3771086-3771119
  misc_feature 1..33: note = Hypo
  source 1..33: mol_type = genomic DNA

SEQ ID NO: 127166 - DNA, 34 bp, Homo sapiens; identical to SEQ ID NO: 97569
  misc_feature 1..34: note = chr7:3942787-3942821
  misc_feature 1..34: note = Hypo
  source 1..34: mol_type = genomic DNA

SEQ ID NO: 127167 - DNA, 30 bp, Homo sapiens; identical to SEQ ID NO: 97572
  misc_feature 1..30: note = chr7:3991878-3991908
  misc_feature 1..30: note = Hypo
  source 1..30: mol_type = genomic DNA

SEQ ID NO: 127168 - DNA, 41 bp, Homo sapiens; identical to SEQ ID NO: 97574
  misc_feature 1..41: note = chr7:4000133-4000174
  misc_feature 1..41: note = Hypo
  source 1..41: mol_type = genomic DNA

SEQ ID NO: 127169 - DNA, 30 bp, Homo sapiens; identical to SEQ ID NO: 97575
  misc_feature 1..30: note = chr7:4000394-4000424
  misc_feature 1..30: note = Hypo
  source 1..30: mol_type = genomic DNA

SEQ ID NO: 127170 - DNA, 30 bp, Homo sapiens; identical to SEQ ID NO: 97576
  misc_feature 1..30: note = chr7:4006028-4006058
  misc_feature 1..30: note = Hypo
  source 1..30: mol_type = genomic DNA

SEQ ID NO: 127171 - DNA, 188 bp, Homo sapiens; identical to SEQ ID NO: 97580
  misc_feature 1..188: note = chr7:4056761-4056949
  misc_feature 1..188: note = Hypo
  source 1..188: mol_type = genomic DNA

SEQ ID NO: 127172 - DNA, 30 bp, Homo sapiens; identical to SEQ ID NO: 97582
  misc_feature 1..30: note = chr7:4066497-4066527
  misc_feature 1..30: note = Hypo
  source 1..30: mol_type = genomic DNA

SEQ ID NO: 127173 - DNA, 30 bp, Homo sapiens; identical to SEQ ID NO: 97583
  misc_feature 1..30: note = chr7:4070228-4070258
  misc_feature 1..30: note = Hypo
  source 1..30: mol_type = genomic DNA

SEQ ID NO: 127174 - DNA, 97 bp, Homo sapiens; identical to SEQ ID NO: 97587
  misc_feature 1..97: note = chr7:4096353-4096450
  misc_feature 1..97: note = Hypo
  source 1..97: mol_type = genomic DNA

SEQ ID NO: 127175 - DNA, 30 bp, Homo sapiens; identical to SEQ ID NO: 97590
  misc_feature 1..30: note = chr7:4119957-4119987
  misc_feature 1..30: note = Hypo
  source 1..30: mol_type = genomic DNA

SEQ ID NO: 127176 - DNA, 30 bp, Homo sapiens; identical to SEQ ID NO: 97591
  misc_feature 1..30: note = chr7:4139378-4139408
  misc_feature 1..30: note = Hypo
  source 1..30: mol_type = genomic DNA

SEQ ID NO: 127177 - DNA, 30 bp, Homo sapiens; identical to SEQ ID NO: 97592
  misc_feature 1..30: note = chr7:4147449-4147479
  misc_feature 1..30: note = Hypo
  source 1..30: mol_type = genomic DNA

SEQ ID NO: 127178 - DNA, 160 bp, Homo sapiens; identical to SEQ ID NO: 97597
  misc_feature 1..160: note = chr7:4183288-4183448
  misc_feature 1..160: note = Hypo
  source 1..160: mol_type = genomic DNA

SEQ ID NO: 127179 - DNA, 56 bp, Homo sapiens; identical to SEQ ID NO: 97600
  misc_feature 1..56: note = chr7:4187810-4187866
  misc_feature 1..56: note = Hypo
  source 1..56: mol_type = genomic DNA

SEQ ID NO: 127180 - DNA, 42 bp, Homo sapiens; identical to SEQ ID NO: 97601
  misc_feature 1..42: note = chr7:4189003-4189045
  misc_feature 1..42: note = Hypo
  source 1..42: mol_type = genomic DNA

SEQ ID NO: 127181 - DNA, 30 bp, Homo sapiens; identical to SEQ ID NO: 97606
  misc_feature 1..30: note = chr7:4206325-4206355
  misc_feature 1..30: note = Hypo
  source 1..30: mol_type = genomic DNA

SEQ ID NO: 127182 - DNA, 30 bp, Homo sapiens; identical to SEQ ID NO: 97607
  misc_feature 1..30: note = chr7:4211243-4211273
  misc_feature 1..30: note = Hypo
  source 1..30: mol_type = genomic DNA

SEQ ID NO: 127183 - DNA, 172 bp, Homo sapiens; identical to SEQ ID NO: 97608
  misc_feature 1..172: note = chr7:4214921-4215093
  misc_feature 1..172: note = Hypo
  source 1..172: mol_type = genomic DNA

SEQ ID NO: 127184 - DNA, 50 bp, Homo sapiens; identical to SEQ ID NO: 97609
  misc_feature 1..50: note = chr7:4215324-4215374
  misc_feature 1..50: note = Hypo
  source 1..50: mol_type = genomic DNA

SEQ ID NO: 127185 - DNA, 30 bp, Homo sapiens; identical to SEQ ID NO: 97615
  misc_feature 1..30: note = chr7:4251136-4251166
  misc_feature 1..30: note = Hypo
  source 1..30: mol_type = genomic DNA

SEQ ID NO: 127186 - DNA, 30 bp, Homo sapiens; identical to SEQ ID NO: 41152
  misc_feature 1..30: note = chr7:4260867-4260897
  misc_feature 1..30: note = Hypo
  source 1..30: mol_type = genomic DNA

SEQ ID NO: 127187 - DNA, 30 bp, Homo sapiens; identical to SEQ ID NO: 97619
  misc_feature 1..30: note = chr7:4265593-4265623
  misc_feature 1..30: note = Hypo
  source 1..30: mol_type = genomic DNA

SEQ ID NO: 127188 - DNA, 55 bp, Homo sapiens; identical to SEQ ID NO: 97620
  misc_feature 1..55: note = chr7:4275488-4275543
  misc_feature 1..55: note = Hypo
  source 1..55: mol_type = genomic DNA

SEQ ID NO: 127189 - DNA, 30 bp, Homo sapiens; identical to SEQ ID NO: 97621
  misc_feature 1..30: note = chr7:4287245-4287275
  misc_feature 1..30: note = Hypo
  source 1..30: mol_type = genomic DNA

SEQ ID NO: 127190 - DNA, 92 bp, Homo sapiens; identical to SEQ ID NO: 97624
  misc_feature 1..92: note = chr7:4299734-4299826
  misc_feature 1..92: note = Hypo
  source 1..92: mol_type = genomic DNA

SEQ ID NO: 127191 - DNA, 30 bp, Homo sapiens; identical to SEQ ID NO: 97626
  misc_feature 1..30: note = chr7:4308164-4308194
  misc_feature 1..30: note = Hypo
  source 1..30: mol_type = genomic DNA

SEQ ID NO: 127192 - DNA, 88 bp, Homo sapiens; identical to SEQ ID NO: 97636
  misc_feature 1..88: note = chr7:4342694-4342782
  misc_feature 1..88: note = Hypo
  source 1..88: mol_type = genomic DNA

SEQ ID NO: 127193 - DNA, 30 bp, Homo sapiens; identical to SEQ ID NO: 97637
  misc_feature 1..30: note = chr7:4345969-4345999
  misc_feature 1..30: note = Hypo
  source 1..30: mol_type = genomic DNA

SEQ ID NO: 127194 - DNA, 83 bp, Homo sapiens; identical to SEQ ID NO: 97668
  misc_feature 1..83: note = chr7:4463665-4463748
  misc_feature 1..83: note = Hypo
  source 1..83: mol_type = genomic DNA

SEQ ID NO: 127195 - DNA, 30 bp, Homo sapiens; identical to SEQ ID NO: 97672
  misc_feature 1..30: note = chr7:4479737-4479767
  misc_feature 1..30: note = Hypo
  source 1..30: mol_type = genomic DNA

SEQ ID NO: 127196 - DNA, 181 bp, Homo sapiens; identical to SEQ ID NO: 97709
  misc_feature 1..181: note = chr7:4751426-4751607
  misc_feature 1..181: note = Hypo
  source 1..181: mol_type = genomic DNA

SEQ ID NO: 127197 - DNA, 150 bp, Homo sapiens; identical to SEQ ID NO: 97714
  misc_feature 1..150: note = chr7:4771565-4771715
  misc_feature 1..150: note = Hypo
  source 1..150: mol_type = genomic DNA

SEQ ID NO: 127198 - DNA, 147 bp, Homo sapiens; identical to SEQ ID NO: 97715
  misc_feature 1..147: note = chr7:4781931-4782078
  misc_feature 1..147: note = Hypo
  source 1..147: mol_type = genomic DNA

SEQ ID NO: 127199 - DNA, 30 bp, Homo sapiens; identical to SEQ ID NO: 97716
  misc_feature 1..30: note = chr7:4782599-4782629
  misc_feature 1..30: note = Hypo
  source 1..30: mol_type = genomic DNA

SEQ ID NO: 127200 - DNA, 40 bp, Homo sapiens; identical to SEQ ID NO: 97717
  misc_feature 1..40: note = chr7:4784887-4784927
  misc_feature 1..40: note = Hyper
  source 1..40: mol_type = genomic DNA

SEQ ID NO: 127201 - DNA, 68 bp, Homo sapiens; identical to SEQ ID NO: 31019
  misc_feature 1..68: note = chr7:4785735-4785803
  misc_feature 1..68: note = Hyper
  source 1..68: mol_type = genomic DNA

SEQ ID NO: 127202 - DNA, 37 bp, Homo sapiens; identical to SEQ ID NO: 97719
  misc_feature 1..37: note = chr7:4802552-4802589
  misc_feature 1..37: note = Hypo
  source 1..37: mol_type = genomic DNA

SEQ ID NO: 127203 - DNA, 30 bp, Homo sapiens; identical to SEQ ID NO: 97720
  misc_feature 1..30: note = chr7:4805834-4805864
  misc_feature 1..30: note = Hypo
  source 1..30: mol_type = genomic DNA

SEQ ID NO: 127204 - DNA, 157 bp, Homo sapiens; identical to SEQ ID NO: 97722
  misc_feature 1..157: note = chr7:4813713-4813870
  misc_feature 1..157: note = Hypo
  source 1..157: mol_type = genomic DNA

SEQ ID NO: 127205 - DNA, 137 bp, Homo sapiens; identical to SEQ ID NO: 97723
  misc_feature 1..137: note = chr7:4837861-4837998
  misc_feature 1..137: note = Hyper
  source 1..137: mol_type = genomic DNA

SEQ ID NO: 127206 - DNA, 288 bp, Homo sapiens; identical to SEQ ID NO: 97724
  misc_feature 1..288: note = chr7:4839163-4839451
  misc_feature 1..288: note = Hypo
  source 1..288: mol_type = genomic DNA

SEQ ID NO: 127207 - DNA, 175 bp, Homo sapiens; identical to SEQ ID NO: 41160
  misc_feature 1..175: note = chr7:4840176-4840351
  misc_feature 1..175: note = Hypo
  source 1..175: mol_type = genomic DNA

SEQ ID NO: 127208 - DNA, 30 bp, Homo sapiens; identical to SEQ ID NO: 41161
  misc_feature 1..30: note = chr7:4840692-4840722
  misc_feature 1..30: note = Hypo
  source 1..30: mol_type = genomic DNA

SEQ ID NO: 127209 - DNA, 177 bp, Homo sapiens; identical to SEQ ID NO: 97727
  misc_feature 1..177: note = chr7:4841057-4841234
  misc_feature 1..177: note = Hypo
  source 1..177: mol_type = genomic DNA

SEQ ID NO: 127210 - DNA, 138 bp, Homo sapiens; identical to SEQ ID NO: 97728
  misc_feature 1..138: note = chr7:4843211-4843349
  misc_feature 1..138: note = Hypo
  source 1..138: mol_type = genomic DNA

SEQ ID NO: 127211 - DNA, 152 bp, Homo sapiens; identical to SEQ ID NO: 97730
  misc_feature 1..152: note = chr7:4855938-4856090
  misc_feature 1..152: note = Hypo
  source 1..152: mol_type = genomic DNA

SEQ ID NO: 127212 - DNA, 453 bp, Homo sapiens; identical to SEQ ID NO: 97731
  misc_feature 1..453: note = chr7:4856843-4857296
  misc_feature 1..453: note = Hypo
  source 1..453: mol_type = genomic DNA

SEQ ID NO: 127213 - DNA, 355 bp, Homo sapiens; identical to SEQ ID NO: 97732
  misc_feature 1..355: note = chr7:4857971-4858326
  misc_feature 1..355: note = Hypo
  source 1..355: mol_type = genomic DNA

SEQ ID NO: 127214 - DNA, 30 bp, Homo sapiens; identical to SEQ ID NO: 97733
  misc_feature 1..30: note = chr7:4864784-4864814
  misc_feature 1..30: note = Hypo
  source 1..30: mol_type = genomic DNA

SEQ ID NO: 127215 - DNA, 112 bp, Homo sapiens; identical to SEQ ID NO: 97734
  misc_feature 1..112: note = chr7:4867556-4867668
  misc_feature 1..112: note = Hypo
  source 1..112: mol_type = genomic DNA

SEQ ID NO: 127216 - DNA, 30 bp, Homo sapiens; identical to SEQ ID NO: 97735
  misc_feature 1..30: note = chr7:4873587-4873617
  misc_feature 1..30: note = Hypo
  source 1..30: mol_type = genomic DNA

SEQ ID NO: 127217 - DNA, 30 bp, Homo sapiens; identical to SEQ ID NO: 97736
  misc_feature 1..30: note = chr7:4874233-4874263
  misc_feature 1..30: note = Hypo
  source 1..30: mol_type = genomic DNA

SEQ ID NO: 127218 - DNA, 59 bp, Homo sapiens; identical to SEQ ID NO: 41165
  misc_feature 1..59: note = chr7:4875008-4875067
  misc_feature 1..59: note = Hypo
  source 1..59: mol_type = genomic DNA

SEQ ID NO: 127219 - DNA, 30 bp, Homo sapiens; identical to SEQ ID NO: 97738
  misc_feature 1..30: note = chr7:4876009-4876039
  misc_feature 1..30: note = Hypo
  source 1..30: mol_type = genomic DNA

SEQ ID NO: 127220 - DNA, 30 bp, Homo sapiens; identical to SEQ ID NO: 41166
  misc_feature 1..30: note = chr7:4876594-4876624
  misc_feature 1..30: note = Hypo
  source 1..30: mol_type = genomic DNA

SEQ ID NO: 127221 - DNA, 205 bp, Homo sapiens; identical to SEQ ID NO: 97740
  misc_feature 1..205: note = chr7:4918324-4918529
  misc_feature 1..205: note = Hypo
  source 1..205: mol_type = genomic DNA

SEQ ID NO: 127222 - DNA, 1080 bp, Homo sapiens
  misc_feature 1..1080: note = chr7:4922549-4923629
  misc_feature 1..1080: note = Hyper
  source 1..1080: mol_type = genomic DNA
gatggtccgcagccccgccagggccctgccaaccccaccaacaggctcctcctgcgaggccccaggagctcggctcagcatctgttatcttggatgcagtatttgtcgaggggctggaaatggtacataaatagccgggaaacaatgctttgagctggcgcacgagtggggatcgggctgcaaccgggacggggtatgtgcaggggacgtctcgccggcccaggtgggagagcgcgcggaaccctgcgccccgctcccccgctgcgccccgctcccccgctgcgcgccccggacgaagctccccctccagggcacagccgggaaaactgagggccgagagtcccctggagttgggggtccggggcccacgcggacagccaggctcaggagctctcgggggtcggcagcgcggacccccggatccccgcaggctgggccgcccttgcccgcgctagccggcctccgggtaccgccccccggtccaggccggggcccgacagccagtcggttcccatggcaactgggcaaacctgccctccgcgccccgaccagcggccgggagtgtccccgagcgcgccccgcggcctccgcgccccaggtccccggcagcggccgagcagcgccccttacgagccacccccggttccgcagtcactcctcgcgcaccccacactcacctccggcacaacccgccgcgccgccacgttcccgcgctgctcccacccgccgttggctggggccggcgcccagacccgcgcgtgccgcggcgcctcctgccggcggcgcaacgggcggggcggggcctcaaggggacggggccacaaagggtggggcgggggagaacaggtgggctggagctgggcctcggcgcccaataggcagaaagaaagcctcgaggaggcggggtctccaggagaggggcggggccaacctgctagaaaaggcgggctgtgctctggcgcctcctgccggccgcccaatggacggggatgcagcctcgagggggcggggcctcaccggagaggcggggttttgaagaaaggggtggggctggttgtggagaggcgggacttgcagccc

SEQ ID NO: 127223 - DNA, 39 bp, Homo sapiens; identical to SEQ ID NO: 41168
  misc_feature 1..39: note = chr7:4931853-4931892
  misc_feature 1..39: note = Hypo
  source 1..39: mol_type = genomic DNA

SEQ ID NO: 127224 - DNA, 174 bp, Homo sapiens; identical to SEQ ID NO: 97747
  misc_feature 1..174: note = chr7:4956774-4956948
  misc_feature 1..174: note = Hypo
  source 1..174: mol_type = genomic DNA

SEQ ID NO: 127225 - DNA, 30 bp, Homo sapiens; identical to SEQ ID NO: 97748
  misc_feature 1..30: note = chr7:4966300-4966330
  misc_feature 1..30: note = Hypo
  source 1..30: mol_type = genomic DNA

SEQ ID NO: 127226 - DNA, 27 bp, Homo sapiens
  misc_feature 1..27: note = chr7:4985872-4985899
  misc_feature 1..27: note = Hypo
  source 1..27: mol_type = genomic DNA
cacaccccaccccgtgcacacaatccc

SEQ ID NO: 127227 - DNA, 958 bp, Homo sapiens
  misc_feature 1..958: note = chr7:4998165-4999123
  misc_feature 1..958: note = Hyper
  source 1..958: mol_type = genomic DNA
cagaggtggtaccaacgccttttaccatgaacaagagtgcccaagagagaccgagcgtaactgcccgagcgtagctggcctgggctccaggcgctgcgcaaagtgctctgcaaggaccagctcgcttaatcctcacggcgacccaggacacggggactcgcataacccccgttttgcaaacgtggaaatgaggttcagagaagtgaagcgacttgcccaatggcacccagcgaggaggcgcgggcgccccggttactccatcccagcgagaagacgaggctgcctgggtcctggttttctcgggcgggggtcaggggtccgccgatcccctctagcgctccgggcggcggggcccgagaaccaaggtggcctccgcggcccccgccgccgcgcgcccctccctccctccccgcggacctccgcggccgccgctcacctcgcgtatttcgtcttctggaaatccagcagccggggggcgaacatcgcggcgcttccatgggaatctggccccgggctcagagcgcgggtagctggcagagcctggggggcgcggcggcggcagcagcaggttggagggcgcgcggcgggggccaaggggacctggtcggcgcccggagccggagccggagcccgagccggagctggaggcgcccggagccgccgacgccaaatcccgagcagatggtggcgggggcggggcgggcgggggcacgggggggctcccgggctcgcgctgccaatcgcctaagcccggccccctccctcccgcgaccccgccgcctccgctgaggtggaggagggtcgtggggagatgggggggtgggagaggtgggggtgaggaagtgggcgtaaggagtgggggcgggacggggggggtcctggctgcgcgcgcgagccacccatcgcccaggcctggggcggccctggccccggccccttttcccggtgccctccctgg

SEQ ID NO: 127228 - DNA, 30 bp, Homo sapiens; identical to SEQ ID NO: 97786
  misc_feature 1..30: note = chr7:5081846-5081876
  misc_feature 1..30: note = Hypo
  source 1..30: mol_type = genomic DNA

SEQ ID NO: 127229 - DNA, 30 bp, Homo sapiens; identical to SEQ ID NO: 97790
  misc_feature 1..30: note = chr7:5112197-5112227
  misc_feature 1..30: note = Hyper
  source 1..30: mol_type = genomic DNA

SEQ ID NO: 127230 - DNA, 37 bp, Homo sapiens; identical to SEQ ID NO: 97794
  misc_feature 1..37: note = chr7:5165566-5165603
  misc_feature 1..37: note = Hypo
  source 1..37: mol_type = genomic DNA

SEQ ID NO: 127231 - DNA, 65 bp, Homo sapiens; identical to SEQ ID NO: 97799
  misc_feature 1..65: note = chr7:5262558-5262623
  misc_feature 1..65: note = Hypo
  source 1..65: mol_type = genomic DNA

SEQ ID NO: 127232 - DNA, 111 bp, Homo sapiens; identical to SEQ ID NO: 97801
  misc_feature 1..111: note = chr7:5305461-5305572
  misc_feature 1..111: note = Hypo
  source 1..111: mol_type = genomic DNA

SEQ ID NO: 127233 - DNA, 128 bp, Homo sapiens; identical to SEQ ID NO: 97804
  misc_feature 1..128: note = chr7:5316311-5316439
  misc_feature 1..128: note = Hypo
  source 1..128: mol_type = genomic DNA

SEQ ID NO: 127234 - DNA, 19 bp, Homo sapiens
  misc_feature 1..19: note = chr7:5320472-5320491
  misc_feature 1..19: note = Hypo
  source 1..19: mol_type = genomic DNA
cagccgtcatgaactttaa

SEQ ID NO: 127235 - DNA, 39 bp, Homo sapiens; identical to SEQ ID NO: 97806
  misc_feature 1..39: note = chr7:5323361-5323400
  misc_feature 1..39: note = Hyper
  source 1..39: mol_type = genomic DNA

SEQ ID NO: 127236 - DNA, 30 bp, Homo sapiens; identical to SEQ ID NO: 97808
  misc_feature 1..30: note = chr7:5328996-5329026
  misc_feature 1..30: note = Hypo
  source 1..30: mol_type = genomic DNA

SEQ ID NO: 127237 - DNA, 98 bp, Homo sapiens; identical to SEQ ID NO: 97809
  misc_feature 1..98: note = chr7:5334502-5334600
  misc_feature 1..98: note = Hypo
  source 1..98: mol_type = genomic DNA

SEQ ID NO: 127238 - DNA, 160 bp, Homo sapiens; identical to SEQ ID NO: 97811
  misc_feature 1..160: note = chr7:5342789-5342949
  misc_feature 1..160: note = Hypo
  source 1..160: mol_type = genomic DNA

SEQ ID NO: 127239 - DNA, 185 bp, Homo sapiens; identical to SEQ ID NO: 97812
  misc_feature 1..185: note = chr7:5343701-5343886
  misc_feature 1..185: note = Hypo
  source 1..185: mol_type = genomic DNA

SEQ ID NO: 127240 - DNA, 142 bp, Homo sapiens; identical to SEQ ID NO: 41173
  misc_feature 1..142: note = chr7:5441304-5441446
  misc_feature 1..142: note = Hypo
  source 1..142: mol_type = genomic DNA

SEQ ID NO: 127241 - DNA, 661 bp, Homo sapiens; identical to SEQ ID NO: 97815
  misc_feature 1..661: note = chr7:5458939-5459600
  misc_feature 1..661: note = Hyper
  source 1..661: mol_type = genomic DNA

SEQ ID NO: 127242 - DNA, 93 bp, Homo sapiens; identical to SEQ ID NO: 97816
  misc_feature 1..93: note = chr7:5460480-5460573
  misc_feature 1..93: note = Hyper
  source 1..93: mol_type = genomic DNA

SEQ ID NO: 127243 - DNA, 50 bp, Homo sapiens; identical to SEQ ID NO: 97824
  misc_feature 1..50: note = chr7:5464999-5465049
  misc_feature 1..50: note = Hyper
  source 1..50: mol_type = genomic DNA

SEQ ID NO: 127244 - DNA, 30 bp, Homo sapiens; identical to SEQ ID NO: 97825
  misc_feature 1..30: note = chr7:5466477-5466507
  misc_feature 1..30: note = Hyper
  source 1..30: mol_type = genomic DNA

SEQ ID NO: 127245 - DNA, 716 bp, Homo sapiens; identical to SEQ ID NO: 97826
  misc_feature 1..716: note = chr7:5467189-5467905
  misc_feature 1..716: note = Hyper
  source 1..716: mol_type = genomic DNA

SEQ ID NO: 127246 - DNA, 30 bp, Homo sapiens; identical to SEQ ID NO: 97829
  misc_feature 1..30: note = chr7:5483425-5483455
  misc_feature 1..30: note = Hypo
  source 1..30: mol_type = genomic DNA

SEQ ID NO: 127247 - DNA, 33 bp, Homo sapiens; identical to SEQ ID NO: 97832
  misc_feature 1..33: note = chr7:5494673-5494706
  misc_feature 1..33: note = Hypo
  source 1..33: mol_type = genomic DNA

SEQ ID NO: 127248 - DNA, 195 bp, Homo sapiens; identical to SEQ ID NO: 97838
  misc_feature 1..195: note = chr7:5521589-5521784
  misc_feature 1..195: note = Hypo
  source 1..195: mol_type = genomic DNA

SEQ ID NO: 127249 - DNA, 105 bp, Homo sapiens; identical to SEQ ID NO: 31029
  misc_feature 1..105: note = chr7:5526299-5526404
  misc_feature 1..105: note = Hyper
  source 1..105: mol_type = genomic DNA

SEQ ID NO: 127250 - DNA, 116 bp, Homo sapiens; identical to SEQ ID NO: 41174
  misc_feature 1..116: note = chr7:5529839-5529955
  misc_feature 1..116: note = Hypo
  source 1..116: mol_type = genomic DNA

SEQ ID NO: 127251 - DNA, 136 bp, Homo sapiens; identical to SEQ ID NO: 97849
  misc_feature 1..136: note = chr7:5589419-5589555
  misc_feature 1..136: note = Hypo
  source 1..136: mol_type = genomic DNA

SEQ ID NO: 127252 - DNA, 198 bp, Homo sapiens; identical to SEQ ID NO: 97858
  misc_feature 1..198: note = chr7:5614360-5614558
  misc_feature 1..198: note = Hyper
  source 1..198: mol_type = genomic DNA

SEQ ID NO: 127253 - DNA, 171 bp, Homo sapiens; identical to SEQ ID NO: 97864
  misc_feature 1..171: note = chr7:5626087-5626258
  misc_feature 1..171: note = Hypo
  source 1..171: mol_type = genomic DNA

SEQ ID NO: 127254 - DNA, 43 bp, Homo sapiens; identical to SEQ ID NO: 97866
  misc_feature 1..43: note = chr7:5629890-5629933
  misc_feature 1..43: note = Hypo
  source 1..43: mol_type = genomic DNA

SEQ ID NO: 127255 - DNA, 569 bp, Homo sapiens; identical to SEQ ID NO: 97867
  misc_feature 1..569: note = chr7:5632903-5633472
  misc_feature 1..569: note = Hyper
  source 1..569: mol_type = genomic DNA

SEQ ID NO: 127256 - DNA, 102 bp, Homo sapiens; identical to SEQ ID NO: 97869
  misc_feature 1..102: note = chr7:5635640-5635742
  misc_feature 1..102: note = Hyper
  source 1..102: mol_type = genomic DNA

SEQ ID NO: 127257 - DNA, 32 bp, Homo sapiens; identical to SEQ ID NO: 97870
  misc_feature 1..32: note = chr7:5637847-5637879
  misc_feature 1..32: note = Hypo
  source 1..32: mol_type = genomic DNA

SEQ ID NO: 127258 - DNA, 23 bp, Homo sapiens
  misc_feature 1..23: note = chr7:5644690-5644713
  misc_feature 1..23: note = Hypo
  source 1..23: mol_type = genomic DNA
actgcggccgagcagaacacgtt

SEQ ID NO: 127259 - DNA, 30 bp, Homo sapiens; identical to SEQ ID NO: 97872
  misc_feature 1..30: note = chr7:5645977-5646007
  misc_feature 1..30: note = Hypo
  source 1..30: mol_type = genomic DNA

SEQ ID NO: 127260 - DNA, 581 bp, Homo sapiens; identical to SEQ ID NO: 97873
  misc_feature 1..581: note = chr7:5647838-5648419
  misc_feature 1..581: note = Hypo
  source 1..581: mol_type = genomic DNA

SEQ ID NO: 127261 - DNA, 16 bp, Homo sapiens
  misc_feature 1..16: note = chr7:5862009-5862025
  misc_feature 1..16: note = Hypo
  source 1..16: mol_type = genomic DNA
gcgcccaaccccaaaa

SEQ ID NO: 127262 - DNA, 30 bp, Homo sapiens; identical to SEQ ID NO: 97883
  misc_feature 1..30: note = chr7:5864832-5864862
  misc_feature 1..30: note = Hypo
  source 1..30: mol_type = genomic DNA

SEQ ID NO: 127263 - DNA, 251 bp, Homo sapiens; identical to SEQ ID NO: 97884
  misc_feature 1..251: note = chr7:5896830-5897081
  misc_feature 1..251: note = Hypo
  source 1..251: mol_type = genomic DNA

SEQ ID NO: 127264 - DNA, 30 bp, Homo sapiens; identical to SEQ ID NO: 97885
  misc_feature 1..30: note = chr7:6060451-6060481
  misc_feature 1..30: note = Hypo
  source 1..30: mol_type = genomic DNA

SEQ ID NO: 127265 - DNA, 56 bp, Homo sapiens; identical to SEQ ID NO: 41180
  misc_feature 1..56: note = chr7:6060716-6060772
  misc_feature 1..56: note = Hypo
  source 1..56: mol_type = genomic DNA

SEQ ID NO: 127266 - DNA, 147 bp, Homo sapiens; identical to SEQ ID NO: 97887
  misc_feature 1..147: note = chr7:6068145-6068292
  misc_feature 1..147: note = Hypo
  source 1..147: mol_type = genomic DNA

SEQ ID NO: 127267 - DNA, 30 bp, Homo sapiens; identical to SEQ ID NO: 97888
  misc_feature 1..30: note = chr7:6068539-6068569
  misc_feature 1..30: note = Hypo
  source 1..30: mol_type = genomic DNA

SEQ ID NO: 127268 - DNA, 17 bp, Homo sapiens
  misc_feature 1..17: note = chr7:6099217-6099234
  misc_feature 1..17: note = Hypo
  source 1..17: mol_type = genomic DNA
tatgccacaaaaaaacg

SEQ ID NO: 127269 - DNA, 94 bp, Homo sapiens; identical to SEQ ID NO: 41182
  misc_feature 1..94: note = chr7:6124620-6124714
  misc_feature 1..94: note = Hypo
  source 1..94: mol_type = genomic DNA

SEQ ID NO: 127270 - DNA, 33 bp, Homo sapiens; identical to SEQ ID NO: 97892
  misc_feature 1..33: note = chr7:6143243-6143276
  misc_feature 1..33: note = Hypo
  source 1..33: mol_type = genomic DNA

SEQ ID NO: 127271 - DNA, 30 bp, Homo sapiens; identical to SEQ ID NO: 97893
  misc_feature 1..30: note = chr7:6188726-6188756
  misc_feature 1..30: note = Hypo
  source 1..30: mol_type = genomic DNA

SEQ ID NO: 127272 - DNA, 32 bp, Homo sapiens; identical to SEQ ID NO: 97894
  misc_feature 1..32: note = chr7:6189029-6189061
  misc_feature 1..32: note = Hypo
  source 1..32: mol_type = genomic DNA

SEQ ID NO: 127273 - DNA, 30 bp, Homo sapiens; identical to SEQ ID NO: 97895
  misc_feature 1..30: note = chr7:6203535-6203565
  misc_feature 1..30: note = Hypo
  source 1..30: mol_type = genomic DNA

SEQ ID NO: 127274 - DNA, 64 bp, Homo sapiens; identical to SEQ ID NO: 41184
  misc_feature 1..64: note = chr7:6241990-6242054
  misc_feature 1..64: note = Hypo
  source 1..64: mol_type = genomic DNA

SEQ ID NO: 127275 - DNA, 46 bp, Homo sapiens; identical to SEQ ID NO: 97908
  misc_feature 1..46: note = chr7:6386422-6386468
  misc_feature 1..46: note = Hypo
  source 1..46: mol_type = genomic DNA

SEQ ID NO: 127276 - DNA, 30 bp, Homo sapiens; identical to SEQ ID NO: 97913
  misc_feature 1..30: note = chr7:6431846-6431876
  misc_feature 1..30: note = Hypo
  source 1..30: mol_type = genomic DNA

SEQ ID NO: 127277 - DNA, 42 bp, Homo sapiens; identical to SEQ ID NO: 97922
  misc_feature 1..42: note = chr7:6438069-6438111
  misc_feature 1..42: note = Hypo
  source 1..42: mol_type = genomic DNA

SEQ ID NO: 127278 - DNA, 196 bp, Homo sapiens; identical to SEQ ID NO: 97925
  misc_feature 1..196: note = chr7:6443279-6443475
  misc_feature 1..196: note = Hypo
  source 1..196: mol_type = genomic DNA

SEQ ID NO: 127279 - DNA, 30 bp, Homo sapiens; identical to SEQ ID NO: 97926
  misc_feature 1..30: note = chr7:6443689-6443719
  misc_feature 1..30: note = Hypo
  source 1..30: mol_type = genomic DNA

SEQ ID NO: 127280 - DNA, 34 bp, Homo sapiens; identical to SEQ ID NO: 41186
  misc_feature 1..34: note = chr7:6443956-6443990
  misc_feature 1..34: note = Hypo
  source 1..34: mol_type = genomic DNA

SEQ ID NO: 127281 - DNA, 93 bp, Homo sapiens; identical to SEQ ID NO: 41187
  misc_feature 1..93: note = chr7:6444050-6444143
  misc_feature 1..93: note = Hypo
  source 1..93: mol_type = genomic DNA

SEQ ID NO: 127282 - DNA, 62 bp, Homo sapiens; identical to SEQ ID NO: 97933
  misc_feature 1..62: note = chr7:6456254-6456316
  misc_feature 1..62: note = Hypo
  source 1..62: mol_type = genomic DNA

SEQ ID NO: 127283 - DNA, 264 bp, Homo sapiens; identical to SEQ ID NO: 97940
  misc_feature 1..264: note = chr7:6499118-6499382
  misc_feature 1..264: note = Hypo
  source 1..264: mol_type = genomic DNA

SEQ ID NO: 127284 - DNA, 30 bp, Homo sapiens; identical to SEQ ID NO: 97941
  misc_feature 1..30: note = chr7:6501094-6501124
  misc_feature 1..30: note = Hypo
  source 1..30: mol_type = genomic DNA

SEQ ID NO: 127285 - DNA, 38 bp, Homo sapiens; identical to SEQ ID NO: 41189
  misc_feature 1..38: note = chr7:6524573-6524611
  misc_feature 1..38: note = Hypo
  source 1..38: mol_type = genomic DNA

SEQ ID NO: 127286 - DNA, 180 bp, Homo sapiens; identical to SEQ ID NO: 41190
  misc_feature 1..180: note = chr7:6524911-6525091
  misc_feature 1..180: note = Hypo
  source 1..180: mol_type = genomic DNA

SEQ ID NO: 127287 - DNA, 189 bp, Homo sapiens; identical to SEQ ID NO: 97947
  misc_feature 1..189: note = chr7:6543051-6543240
  misc_feature 1..189: note = Hyper
  source 1..189: mol_type = genomic DNA

SEQ ID NO: 127288 - DNA, 311 bp, Homo sapiens; identical to SEQ ID NO: 97950
  misc_feature 1..311: note = chr7:6545692-6546003
  misc_feature 1..311: note = Hypo
  source 1..311: mol_type = genomic DNA

SEQ ID NO: 127289 - DNA, 228 bp, Homo sapiens; identical to SEQ ID NO: 41192
  misc_feature 1..228: note = chr7:6560173-6560401
  misc_feature 1..228: note = Hypo
  source 1..228: mol_type = genomic DNA

SEQ ID NO: 127290 - DNA, 643 bp, Homo sapiens
  misc_feature 1..643: note = chr7:6566051-6566694
  misc_feature 1..643: note = Hyper
  source 1..643: mol_type = genomic DNA
ccagatgcccagccccgcccctacgccctctccccgggtctcggtcccgagcccacccgcagggaggcgcccgctgccagtgcctgtgagccccgcgtacctgcgcgcgcccccggggccggcgaggccgcccaccagcaaggaggccctgcgcgggggcggctcatcggggcggcgcggcggggcgctggcgcgcgtggacaccaggaggcgctccggccgctcctcgctgcggctccggcgcagtcgctgcgcgccctgggcccggcgtgcgcggcacagcttgcccaggaggccctgagacaccacctcgtcgaagcgcgcccggtgcttcttggggatgaagatcctgccggcgaggacggcggagtcggggcgcgttcccggaccccggatctctgcaaaccgcggcccgaaggcgcgtcctcgcgggcgccgccctaggctctcccacctcttcctaggagtggcggagggctggggggatcgggatgagcagccggtagcaccccagtctccccctcgctgctcggatttgcgcccccagctaggacttggcgtcctgctcgcttcacctcgggaatggcccgttcggaccgtcctccatgactctggccactgcagggcccgagcccctcaaagc

SEQ ID NO: 127291 - DNA, 755 bp, Homo sapiens
  misc_feature 1..755: note = chr7:6570454-6571209
  misc_feature 1..755: note = Hyper
  source 1..755: mol_type = genomic DNA
gactctttagggccacgcacgggttctgagcgcccaacgcttagacctcgccgccccggtacccaccgagtttatttccaacctccctgggcctcgggctccgcccaggctcggagggtgcccacccagggcagggaagcccctccacgctccagccccacccgctttcagaccagcccgaggcggatccgtggcgcagagggcgcacggttcccggaggcgcgggacgcgatggggaagctaccgaaagtgccgagagaagccctggtccttccccatctggagccggggaccgcggcgcggcaggtgccgaagggcagggggtagccgagcccaggaatggagcgagcgcgccgcgactccacgcacctctgccctgcgagcgcgcgcggcccctcccgagccgtcccggcccgcagccccgccctggccccttttggtggccccgccccctccaggtagccccgcctctgccctgctgggacccttttggtcgctctggggtgcagcggaaactggcggcggtttgaagccgccgcgctcactccccttggctctctccgttattcccttcccaggatcctcgcctgcgtcctctccagctactgcgccccggacccccacacagtggcgagtccccgcagttcagaggaagccccgacggcctttggtagaacatgcaatattttccggaggggatgccctttacgctgggcctccagggctcagcaggagtcggccggctagaagaagcc

SEQ ID NO: 127292 - DNA, 64 bp, Homo sapiens; identical to SEQ ID NO: 97961
  misc_feature 1..64: note = chr7:6576033-6576097
  misc_feature 1..64: note = Hyper
  source 1..64: mol_type = genomic DNA

SEQ ID NO: 127293 - DNA, 400 bp, Homo sapiens; identical to SEQ ID NO: 97972
  misc_feature 1..400: note = chr7:6654761-6655161
  misc_feature 1..400: note = Hyper
  source 1..400: mol_type = genomic DNA

SEQ ID NO: 127294 - DNA, 30 bp, Homo sapiens; identical to SEQ ID NO: 31039
  misc_feature 1..30: note = chr7:6655418-6655448
  misc_feature 1..30: note = Hyper
  source 1..30: mol_type = genomic DNA

SEQ ID NO: 127295 - DNA, 186 bp, Homo sapiens; identical to SEQ ID NO: 97974
  misc_feature 1..186: note = chr7:6655668-6655854
  misc_feature 1..186: note = Hyper
  source 1..186: mol_type = genomic DNA

SEQ ID NO: 127296 - DNA, 600 bp, Homo sapiens
  misc_feature 1..600: note = chr7:6703488-6704088
  misc_feature 1..600: note = Hyper
  source 1..600: mol_type = genomic DNA
agaaggtgtgccaggcgatggagggggtcggcgggggcggggcccgcactgtccccgccccatgtgggtggagcctcctgcccgggcctgtgtcgcggcagagcctggcgggctttgtgcgcaggcgcttgcggcttcgcggggctgaccgtgcgcttcgcctgcggggtcgtgctggggcggcgggtgagcctggggggctgcagagcgggcgcggggcgcgtccgaacagtcgcagccccgagcccctgggaccgccttccccgcggaggcttgggctcagcgcctggggcggaggtggggcgggggcggtccgcccgcagcagggggtgccggggccgcctccgggtttcctccgctggatgcggcggtggtgcgctgtcggcccggcgggtgcggcgggtgtggggtcacgggtgtcgcgcgccgccctgggccctcctccgaggtgcctcgcgtggggcccgtgccagggcccgctgagtcggggccgctcgtgggccgcctggctgccgcctggggcctccggccgctgcgtcccgcggcttctgggaaccgtgcgcgctcacaggcggacttgggcctcgaacaaggttcctg

SEQ ID NO: 127297 - DNA, 48 bp, Homo sapiens; identical to SEQ ID NO: 98010
  misc_feature 1..48: note = chr7:6966936-6966984
  misc_feature 1..48: note = Hypo
  source 1..48: mol_type = genomic DNA

SEQ ID NO: 127298 - DNA, 141 bp, Homo sapiens; identical to SEQ ID NO: 98016
  misc_feature 1..141: note = chr7:7019112-7019253
  misc_feature 1..141: note = Hypo
  source 1..141: mol_type = genomic DNA

SEQ ID NO: 127299 - DNA, 97 bp, Homo sapiens; identical to SEQ ID NO: 98027
  misc_feature 1..97: note = chr7:7097210-7097307
  misc_feature 1..97: note = Hypo
  source 1..97: mol_type = genomic DNA

SEQ ID NO: 127300 - DNA, 217 bp, Homo sapiens; identical to SEQ ID NO: 98028
  misc_feature 1..217: note = chr7:7097367-7097584
  misc_feature 1..217: note = Hypo
  source 1..217: mol_type = genomic DNA

SEQ ID NO: 127301 - DNA, 80 bp, Homo sapiens; identical to SEQ ID NO: 98029
  misc_feature 1..80: note = chr7:7098076-7098156
  misc_feature 1..80: note = Hypo
  source 1..80: mol_type = genomic DNA

SEQ ID NO: 127302 - DNA, 93 bp, Homo sapiens; identical to SEQ ID NO: 98030
  misc_feature 1..93: note = chr7:7099482-7099575
  misc_feature 1..93: note = Hypo
  source 1..93: mol_type = genomic DNA

SEQ ID NO: 127303 - DNA, 51 bp, Homo sapiens; identical to SEQ ID NO: 98031
  misc_feature 1..51: note = chr7:7101398-7101449
  misc_feature 1..51: note = Hypo
  source 1..51: mol_type = genomic DNA

SEQ ID NO: 127304 - DNA, 45 bp, Homo sapiens; identical to SEQ ID NO: 98032
  misc_feature 1..45: note = chr7:7101778-7101823
  misc_feature 1..45: note = Hypo
  source 1..45: mol_type = genomic DNA

SEQ ID NO: 127305 - DNA, 45 bp, Homo sapiens; identical to SEQ ID NO: 98033
  misc_feature 1..45: note = chr7:7101883-7101928
  misc_feature 1..45: note = Hypo
  source 1..45: mol_type = genomic DNA

SEQ ID NO: 127306 - DNA, 30 bp, Homo sapiens; identical to SEQ ID NO: 98034
  misc_feature 1..30: note = chr7:7102527-7102557
  misc_feature 1..30: note = Hypo
  source 1..30: mol_type = genomic DNA

SEQ ID NO: 127307 - DNA, 30 bp, Homo sapiens; identical to SEQ ID NO: 14975
  misc_feature 1..30: note = chr7:7102938-7102968
  misc_feature 1..30: note = Hypo
  source 1..30: mol_type = genomic DNA

SEQ ID NO: 127308 - DNA, 37 bp, Homo sapiens; identical to SEQ ID NO: 98036
  misc_feature 1..37: note = chr7:7105793-7105830
  misc_feature 1..37: note = Hypo
  source 1..37: mol_type = genomic DNA

SEQ ID NO: 127309 - DNA, 30 bp, Homo sapiens; identical to SEQ ID NO: 98037
  misc_feature 1..30: note = chr7:7106198-7106228
  misc_feature 1..30: note = Hypo
  source 1..30: mol_type = genomic DNA

SEQ ID NO: 127310 - DNA, 61 bp, Homo sapiens; identical to SEQ ID NO: 41195
  misc_feature 1..61: note = chr7:7109343-7109404
  misc_feature 1..61: note = Hypo
  source 1..61: mol_type = genomic DNA

SEQ ID NO: 127311 - DNA, 162 bp, Homo sapiens; identical to SEQ ID NO: 98039
  misc_feature 1..162: note = chr7:7110642-7110804
  misc_feature 1..162: note = Hypo
  source 1..162: mol_type = genomic DNA

SEQ ID NO: 127312 - DNA, 360 bp, Homo sapiens; identical to SEQ ID NO: 98040
  misc_feature 1..360: note = chr7:7111756-7112116
  misc_feature 1..360: note = Hypo
  source 1..360: mol_type = genomic DNA

SEQ ID NO: 127313 - DNA, 42 bp, Homo sapiens; identical to SEQ ID NO: 41197
  misc_feature 1..42: note = chr7:7113636-7113678
  misc_feature 1..42: note = Hypo
  source 1..42: mol_type = genomic DNA

SEQ ID NO: 127314 - DNA, 30 bp, Homo sapiens; identical to SEQ ID NO: 98066
  misc_feature 1..30: note = chr7:7284851-7284881
  misc_feature 1..30: note = Hypo
  source 1..30: mol_type = genomic DNA

SEQ ID NO: 127315 - DNA, 279 bp, Homo sapiens; identical to SEQ ID NO: 41198
  misc_feature 1..279: note = chr7:7605145-7605424
  misc_feature 1..279: note = Hypo
  source 1..279: mol_type = genomic DNA

SEQ ID NO: 127316 - DNA, 158 bp, Homo sapiens; identical to SEQ ID NO: 41199
  misc_feature 1..158: note = chr7:7605664-7605822
  misc_feature 1..158: note = Hypo
  source 1..158: mol_type = genomic DNA

SEQ ID NO: 127317 - DNA, 94 bp, Homo sapiens; identical to SEQ ID NO: 98076
  misc_feature 1..94: note = chr7:7606031-7606125
  misc_feature 1..94: note = Hypo
  source 1..94: mol_type = genomic DNA

SEQ ID NO: 127318 - DNA, 40 bp, Homo sapiens; identical to SEQ ID NO: 98116
  misc_feature 1..40: note = chr7:8343744-8343784
  misc_feature 1..40: note = Hypo
  source 1..40: mol_type = genomic DNA

SEQ ID NO: 127319 - DNA, 39 bp, Homo sapiens; identical to SEQ ID NO: 98118
  misc_feature 1..39: note = chr7:8391330-8391369
  misc_feature 1..39: note = Hypo
  source 1..39: mol_type = genomic DNA

SEQ ID NO: 127320 - DNA, 2428 bp, Homo sapiens
  misc_feature 1..2428: note = chr7:8473070-8475498
  misc_feature 1..2428: note = Hyper
  source 1..2428: mol_type = genomic DNA
agagacagccagagtcggagcacagaggccgagtctgggagacgctggttgagtgggaggtgtcagtagcgagggaggtggtgacggctcgaagcatcccccgtcctcctcctcccccttcacgctcagcccagccggcggcgaggagtccagaggccaaggtcgcccagtcctctcggctgtctcgagctgaatggctggcagtctgcggctcccccgcctccggcccggcagccacaggtcggaggcgcccggcgtcggcgctcgaggccggcaggggcgccctgcaccctcccgcgcccttccccgccctacgcgactcccggctgctcttcccgccactcccctgggctttgcgatcttccctacgccccccgggaagggggcgctgcggccaccgaagacaccgcgggagccacttgtccctgtgggcccagcccgcgagagcctgagagccggatctgtttacacagggtactaattagtctttgaggaatcattcacccacgtgccaaagtaattgtccgtgtcaggaaggtaggcgtgccaagccgcggctctgcggagaaaccacgaccaccgcggccgccggaaacccaaagcgctccagagcgtccccgggtggccgggcagcaccagggacagcgcccgggactccactggggaccggctcctgggcttcccagcgtcgcgggtagaggtacagctgctccgtgtgccgcaggctccagattctcgccaccccacccctccctcagaaactcggactgctctcgtctgccgtgtggttctcttttcttccgaaaggccagtgtcttatctctccacttcaagtccagaggacttgctcagtctcctccccttaagtcatttccaccatcctcaggcagctgtgggaagccgagagtcctggactgttcgtccgggtgccagcgctggcagtcccagtccgtccggtgcagcagcccggcgcattcccctctctccctccctcttgctctccctccctttctgtcttcctctctttcctcctctactgctccctccctctcttgcctcttaagtttcctgcaccgtgaatccaactgtgccaagccttggctcccgcgaaccaatcctgagcgcgacccgggcactgggacggcgactccgccaaagctggacgaggcagccggacccgtctgcgctcgagcatggagacggagcgcctgggagggcacgtccggggcgctggagacgccaggcccgagtagcttctccatggagcctgcccagagcggtcccttctcgcaggattcgccccaagtcctgtgcggtacgtaccctttgcctccgctgttcccggagggtacacctgggagcggggtggtgggcacgaggaagggacggcagggaggggcgctggttaggaaagagaacaagcctggcaggtgaccctcacagctcggaggaggcttcttctctagaagttagcgaccggctgtaccctttggctcgaaaaaagtagtgctagagatgtgactgtgagcattcgtgggtatctctgtgtgcgccaggggttcgaatgggtaaactgatccctgctttcctgtatgcaaattgcattctctttccccacccccacttcaccgaacgtgttgaggtacctagcacctaatcgcggtcagttctacctacctcttcctctcaccgcgcccccctcgctcaatctctctctctccctttatctttcccctctatctctctctgctggtgtgtacgtgtgtgagcactgccagggctggcgaagaaccagccgccgcctttagtccgagccgccgggccacccaacacaagggcaggtctcgctgccggagaagcctgggctccgaaccagcctgcacgcggctcagtgtgctccgccgcctgggaactcgcacccgaggagcgcagggggcaaggagcccctcaccctccctctcgtccgcccgcccgcctccccagctgcggaccgcgcgcttgctggtctcaggcgctggatttactcgcttttcaatttttcgtaccctccctcccttttttttttggtcccccactccccgctacgaccccctttccccgcttgattgtcaagcctaaccttgcccgcgtagtcatgggatgtctaattttatttgcatctaggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttggtaagtcttggaaggttcggggctttcgcatttttaccccggccgggaggcaaggaaactggggacacgcgggagaagggttacgccgccagttcagtgag

SEQ ID NO: 127321 - DNA, 445 bp, Homo sapiens; identical to SEQ ID NO: 98122
  misc_feature 1..445: note = chr7:8476305-8476750
  misc_feature 1..445: note = Hyper
  source 1..445: mol_type = genomic DNA

SEQ ID NO: 127322 - DNA, 30 bp, Homo sapiens; identical to SEQ ID NO: 98124
  misc_feature 1..30: note = chr7:8477418-8477448
  misc_feature 1..30: note = Hyper
  source 1..30: mol_type = genomic DNA

SEQ ID NO: 127323 - DNA, 329 bp, Homo sapiens; identical to SEQ ID NO: 98125
  misc_feature 1..329: note = chr7:8480721-8481050
  misc_feature 1..329: note = Hyper
  source 1..329: mol_type = genomic DNA

SEQ ID NO: 127324 - DNA, 2713 bp, Homo sapiens
  misc_feature 1..2713: note = chr7:8481310-8484023
  misc_feature 1..2713: note = Hyper
  source 1..2713: mol_type = genomic DNA
caagctttccaagagcggctttttattgagataatatattttggcggcttcttcaaacccctccgcgcgcccaagagcgcgtttgcgcattttccaagtttgccctgccctcgcgggttggtggctgttgtttaaacttctgatgagcgcgctgcgtttctgctacgggatgaaaacctaattacctcctctgcaaagagctttccctagtatattttattgattgcggaggtgggagccggcagggggtctgtgggggtgggcggggaggggattctcttgctccggtgccctctgttgccgaaagttccttaggcgtctagtcaggggttcggggtggtggaaagcgagatggcgttgggagccagggcgttgggacggcacaagcagtggggtcccaggagcagcaagacagtagctcctctcgggccacggcttacgaaaagctttcctagctccttcttcctataaattaatgagggtattttactcgttcaagccggaaatacgatggggagggggagacacaggccgcatccagagcgcatcgcctcatctgcatgagaatggagaaccgggaggcttttcttgtactgtttctttctcccacaataagacaaattgctgcttagaaaaactgagtgtttccttagaaactggcttgcgggagctctgcgcgtccccgctgaacctgcctctggccgcgcctcgccatcacccccgccgccctaatggattctgaagcgaaggatcctagctgccgcggctaagggcgcagggggaggccgcgcgtcctcgccacaccggaaggagagggcatccggctcacacatcccaccctatgtcttagaccccgtcctcacacattgactttaaaaggccattttccttcgtcttctacaagaagcaagaaacttttttcgacgtaggcttcataccctcccttcggaaactcagtccgctgaccaaagccgcagtgttcaggccccggggtttcccagccgtagtggccgccgccacagctgcgcgctttattgtctgctttcagtcgcaggtgacctcgagcgatctcgacaggtttatggaaacacagatgcagccctctcgcgtccggagcccaagtccccatgcaaaagcgctgtttctgggtaattttcgtcgacgccaccaagcttcggtgcttttgggacagcgggctggatagcggcagttctcgggagaataggccgcgggctataagatttgatcgcgggcaggcgggcgtggggcacgccagggccgggagagcgactcttcagcaccacggccagcgccacaggctccgccccgcctggtgccagcagtagggcctgcctcccccgctgccgctccggctgggtccttaaagtcgagttagcactctcggtttccgcagatacctcctcaaggcccgctcgcgactgtgacgacccgcctaccccttccagctattcggggggcagctagctcccgtctctaggtccccagcatgacctgcggtcagaaactcttgcttgcacccctctccattaccacactcagtggttgcggcgtcacgtgatcaccacggagattttgcgaatccttcttttccccaacttctccccctacccagtctcccattctttcacagttcattaaatctacccctcccccgaaacagaaacgtgaaggctgtaacgaagagctagaagtgtctctagtaatgtaaaagtctcaactgacagacaaggaaactgaggcaaccaacttattcgcaagagtaaaaccctatggggagaagcgattcctgcccctcttcccccggcgaggaacacggctggagccacccaggcgccttccaggctaaggcgcctttagcggcgcgcaggggtgagggagagggtggggagagtcctaattattatgaatttctaaaggcgcagtaattattcacggggagcaggacaaaccatggctaggcagggaaatcgatatatttgctatcgaaagttcctggctcgcctttaatgcagacgaatgggggatgcagcctcattattttccgtggttaggctcgccagcgtggggcctgatgcagcgtgaaatctatcatcattagacccgggatggagcggcgggggggagtttctctttacttaccaaaccgcaacaacaaacaaacaacgacgaacaaccgccccctacaaacactcattctcacacaacgttgccctacctccctcgccgcttgccctggccgctgttgcacactcccctgggggctgtctgcacgccctagagcagacactgcggtcacttaaagtgcgcccagttcctccaccgcagcggtcacaccgttgatttgatccagaaataagacggatagtaccgagcgttggcgctaggggttgtctatgtcaaaggcgaaggttggctgggaagttctgtccgtttctcttgccttagcataggagtcaatccttttcttgtcacccgattctgcaaattctcgctgtattaaaggagcagagatctggcatgtagtgctccattaacccgtagcataagttagctcggacataaggcaagccctcgagaagggaacgaatcagaaggtgaaaagagcggtcggaaggtgaggaagagaaggtttaggcgcaacgcctcggaggtattctctgaggccctggcgagatttcggcctttagcttaa

SEQ ID NO: 127325 - DNA, 30 bp, Homo sapiens; identical to SEQ ID NO: 98253
  misc_feature 1..30: note = chr7:9766521-9766551
  misc_feature 1..30: note = Hypo
  source 1..30: mol_type = genomic DNA

SEQ ID NO: 127326 - DNA, 22 bp, Homo sapiens
  misc_feature 1..22: note = chr7:9772342-9772364
  misc_feature 1..22: note = Hypo
  source 1..22: mol_type = genomic DNA
ttacaggcgtgagccaccgtgc

SEQ ID NO: 127327 - DNA, 23 bp, Homo sapiens
  misc_feature 1..23: note = chr7:9955375-9955398
  misc_feature 1..23: note = Hypo
  source 1..23: mol_type = genomic DNA
actgtgcccggccatgttgatga

SEQ ID NO: 127328 - DNA, 149 bp, Homo sapiens; identical to SEQ ID NO: 96187
  misc_feature 1..149: note = chr7:10730732-10730881
  misc_feature 1..149: note = Hypo
  source 1..149: mol_type = genomic DNA

SEQ ID NO: 127329 - DNA, 37 bp, Homo sapiens; identical to SEQ ID NO: 41202
  misc_feature 1..37: note = chr7:10819400-10819437
  misc_feature 1..37: note = Hypo
  source 1..37: mol_type = genomic DNA

SEQ ID NO: 127330 - DNA, 30 bp, Homo sapiens; identical to SEQ ID NO: 41203
  misc_feature 1..30: note = chr7:10929379-10929409
  misc_feature 1..30: note = Hypo
  source 1..30: mol_type = genomic DNA

SEQ ID NO: 127331 - DNA, 465 bp, Homo sapiens; identical to SEQ ID NO: 31055
  misc_feature 1..465: note = chr7:11871392-11871857
  misc_feature 1..465: note = Hyper
  source 1..465: mol_type = genomic DNA

SEQ ID NO: 127332 - DNA, 613 bp, Homo sapiens
  misc_feature 1..613: note = chr7:12151126-12151739
  misc_feature 1..613: note = Hyper
  source 1..613: mol_type = genomic DNA
gacaagacttacaagcgacgatgctgacggtggactcttgcccagggatctgggcagagcgtgggagggcctgtggggcctggggttctctctgcgcacgaaatccggggcgggcactatgtgattcgagcccgctgcgccctgggctcctcgtgtcgcccgcggggaaaggaggagggagactgctcacatggcccacttcgcggcctgagatggagtgcgcgcagggcgtcagggcagagggaggcggggattcaggataaagagcggcctgatgcccagagccgggtgcccggacctcctgcctcctgcttctgatccctgcaagccgcccaccctgcgatcgccgggtcccgccctgacaatgccctgccgccagttccagccccagtgcagccgtcgccggtcctgtgcgcctctggtggcgcgtgcgccctgtccttccctgcccaagagggagaaccctcagtgccccagcctcagctctgcgcacagcggtcccctgcatgtccgcactcctgttctgtactgcacgctcgccagagcacagagccccatgtcccattgcgagggtcccacagagggcagtagccaccctcggaatccataccct

SEQ ID NO: 127333 - DNA, 30 bp, Homo sapiens; identical to SEQ ID NO: 96287
  misc_feature 1..30: note = chr7:12442920-12442950
  misc_feature 1..30: note = Hyper
  source 1..30: mol_type = genomic DNA

SEQ ID NO: 127334 - DNA, 424 bp, Homo sapiens; identical to SEQ ID NO: 31058
  misc_feature 1..424: note = chr7:12443294-12443718
  misc_feature 1..424: note = Hyper
  source 1..424: mol_type = genomic DNA

SEQ ID NO: 127335 - DNA, 30 bp, Homo sapiens; identical to SEQ ID NO: 31059
  misc_feature 1..30: note = chr7:12610212-12610242
  misc_feature 1..30: note = Hyper
  source 1..30: mol_type = genomic DNA

SEQ ID NO: 127336 - DNA, 44 bp, Homo sapiens
  misc_feature 1..44: note = chr7:12610636-12610680
  misc_feature 1..44: note = Hyper
  source 1..44: mol_type = genomic DNA
ccgacgcaccaaggccggcgaggggagggcgtaggggtctgaga

SEQ ID NO: 127337 - DNA, 44 bp, Homo sapiens; identical to SEQ ID NO: 96312
  misc_feature 1..44: note = chr7:12750788-12750832
  misc_feature 1..44: note = Hypo
  source 1..44: mol_type = genomic DNA

SEQ ID NO: 127338 - DNA, 30 bp, Homo sapiens; identical to SEQ ID NO: 96313
  misc_feature 1..30: note = chr7:12751560-12751590
  misc_feature 1..30: note = Hypo
  source 1..30: mol_type = genomic DNA

SEQ ID NO: 127339 - DNA, 23 bp, Homo sapiens
  misc_feature 1..23: note = chr7:12776931-12776954
  misc_feature 1..23: note = Hypo
  source 1..23: mol_type = genomic DNA
agtcactgcgcctggccagtgtt

SEQ ID NO: 127340 - DNA, 30 bp, Homo sapiens; identical to SEQ ID NO: 96519
  misc_feature 1..30: note = chr7:14029041-14029071
  misc_feature 1..30: note = Hyper
  source 1..30: mol_type = genomic DNA

SEQ ID NO: 127341 - DNA, 62 bp, Homo sapiens; identical to SEQ ID NO: 96520
  misc_feature 1..62: note = chr7:14029493-14029555
  misc_feature 1..62: note = Hyper
  source 1..62: mol_type = genomic DNA

SEQ ID NO: 127342 - DNA, 384 bp, Homo sapiens; identical to SEQ ID NO: 96521
  misc_feature 1..384: note = chr7:14029885-14030269
  misc_feature 1..384: note = Hyper
  source 1..384: mol_type = genomic DNA

SEQ ID NO: 127343 - DNA, 29 bp, Homo sapiens
  misc_feature 1..29: note = chr7:15431976-15432005
  misc_feature 1..29: note = Hypo
  source 1..29: mol_type = genomic DNA
tgagtcaacatgcccggccctatttcctt

SEQ ID NO: 127344 - DNA, 155 bp, Homo sapiens; identical to SEQ ID NO: 96695
  misc_feature 1..155: note = chr7:15435723-15435878
  misc_feature 1..155: note = Hypo
  source 1..155: mol_type = genomic DNA

SEQ ID NO: 127345 - DNA, 261 bp, Homo sapiens; identical to SEQ ID NO: 31061
  misc_feature 1..261: note = chr7:15725085-15725346
  misc_feature 1..261: note = Hyper
  source 1..261: mol_type = genomic DNA

SEQ ID NO: 127346 - DNA, 570 bp, Homo sapiens; identical to SEQ ID NO: 96875
  misc_feature 1..570: note = chr7:15725636-15726206
  misc_feature 1..570: note = Hyper
  source 1..570: mol_type = genomic DNA

SEQ ID NO: 127347 - DNA, 620 bp, Homo sapiens; identical to SEQ ID NO: 96878
  misc_feature 1..620: note = chr7:15726457-15727077
  misc_feature 1..620: note = Hyper
  source 1..620: mol_type = genomic DNA

SEQ ID NO: 127348 - DNA, 54 bp, Homo sapiens; identical to SEQ ID NO: 31064
  misc_feature 1..54: note = chr7:15727290-15727344
  misc_feature 1..54: note = Hyper
  source 1..54: mol_type = genomic DNA

SEQ ID NO: 127349 - DNA, 92 bp, Homo sapiens; identical to SEQ ID NO: 97072
  misc_feature 1..92: note = chr7:16437156-16437248
  misc_feature 1..92: note = Hypo
  source 1..92: mol_type = genomic DNA

SEQ ID NO: 127350 - DNA, 191 bp, Homo sapiens; identical to SEQ ID NO: 97073
  misc_feature 1..191: note = chr7:16460326-16460517
  misc_feature 1..191: note = Hyper
  source 1..191: mol_type = genomic DNA

SEQ ID NO: 127351 - DNA, 408 bp, Homo sapiens; identical to SEQ ID NO: 97074
  misc_feature 1..408: note = chr7:16460890-16461298
  misc_feature 1..408: note = Hyper
  source 1..408: mol_type = genomic DNA

SEQ ID NO: 127352 - DNA, 189 bp, Homo sapiens; identical to SEQ ID NO: 97075
  misc_feature 1..189: note = chr7:16531866-16532055
  misc_feature 1..189: note = Hypo
  source 1..189: mol_type = genomic DNA

SEQ ID NO: 127353 - DNA, 63 bp, Homo sapiens; identical to SEQ ID NO: 97077
  misc_feature 1..63: note = chr7:16566510-16566573
  misc_feature 1..63: note = Hypo
  source 1..63: mol_type = genomic DNA

SEQ ID NO: 127354 - DNA, 47 bp, Homo sapiens; identical to SEQ ID NO: 97079
  misc_feature 1..47: note = chr7:16793964-16794011
  misc_feature 1..47: note = Hyper
  source 1..47: mol_type = genomic DNA

SEQ ID NO: 127355 - DNA, 227 bp, Homo sapiens; identical to SEQ ID NO: 97082
  misc_feature 1..227: note = chr7:16844142-16844369
  misc_feature 1..227: note = Hypo
  source 1..227: mol_type = genomic DNA

SEQ ID NO: 127356 - DNA, 30 bp, Homo sapiens; identical to SEQ ID NO: 97104
  misc_feature 1..30: note = chr7:17339561-17339591
  misc_feature 1..30: note = Hyper
  source 1..30: mol_type = genomic DNA

SEQ ID NO: 127357 - DNA, 34 bp, Homo sapiens; identical to SEQ ID NO: 97107
  misc_feature 1..34: note = chr7:17413242-17413276
  misc_feature 1..34: note = Hypo
  source 1..34: mol_type = genomic DNA

SEQ ID NO: 127358 - DNA, 253 bp, Homo sapiens
  misc_feature 1..253: note = chr7:18125972-18126225
  misc_feature 1..253: note = Hyper
  source 1..253: mol_type = genomic DNA
gagccacggggggcgcgagagggcgaggcagcggcctggcttctccccagcaccgttctctgtcacggccgccgcctgaccatcaccccgcgcctcgcgtgggcatgtctcgcttcagaaatcccaagtcgtcttaggttccctggtccttcccctgggggggaaaaaaaacgctggtgcagcccagagcccttttccgctccaccccgggatgtcctcgctgccctcccgcctcccgcgcgtccttcccagc

SEQ ID NO: 127359 - DNA, 600 bp, Homo sapiens
  misc_feature 1..600: note = chr7:18126443-18127043
  misc_feature 1..600: note = Hyper
  source 1..600: mol_type = genomic DNA
ttttagcaaattctccgcgcgccgccgcccgctcagctcgcagctcgcagccgcccgctgccgccctcccgagccccccccgcgcggcggcggcggcggcggcggcggcggcgcgtcccgcacatcgcgcagcgcgcaccgagccggccgcgccgcgcccgccgctctcgccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtgagtggcaccacggcagagtccccggctggtgcttgaggaaagccctgggaattgggggccaccggtcctcaggatgcgccgcggtattcccttctcgggttccgcaggttaacagcatctcagtccggactctgatgccacttgccttgcatctcgcagcccggagaccggtgggtttaagggaaccttcgtcagaagttgggt

SEQ ID NO: 127360 - DNA, 774 bp, Homo sapiens
  misc_feature 1..774: note = chr7:19145808-19146582
  misc_feature 1..774: note = Hyper
  source 1..774: mol_type = genomic DNA
aatccccccattccccgttcccaatctattacatttcaaaggaggagaaagaactggaaaaccccgtttcctttgagaaacgcgtccgcggcagctactgagggtctgccccacctttagcttcaggttgacaactgccttcagcgcgttctcagctcagctggccctatgggtcccctaaaatcgcccgagcgtccgccctgtctgacctgcccccctgccgcggcgcacatttcagcttttcagcttcacggtggagctcgcagtaattgagtcgcgagggttatttttcctggcctcacctcgcggtcctgagcctgcagggagctttcggaaagacatcgccccctccccctgagtccccggcagcttctgaacgctgcgcgggtctccgccccgcgggaaccaggattgcgatccgttcctcggcggctagaggttgaggccggaggctgacaccaccagggacccaacggagggtttattctgcccagcttcacatctgggggtcaaatcgcattaaagccaaaccaccaacggggcagggagcaggtggttaactgcacaaaataaagttacagaaaaaacctcgttttgcaggcgagtgacttagtttccctctgtagctttgccgtcataaaaagcaagtccctcccctctcctgagctggaaggcggggaaaggttatcagcggctccagatggacgcccgtaggcagggtcagtttaggaagaccggcaggcaggcgtattaggcgcgcgggctcccatcctc

SEQ ID NO: 127361 - DNA, 974 bp, Homo sapiens; identical to SEQ ID NO: 97137
  misc_feature 1..974: note = chr7:19146925-19147899
  misc_feature 1..974: note = Hyper
  source 1..974: mol_type = genomic DNA

SEQ ID NO: 127362 - DNA, 146 bp, Homo sapiens
  misc_feature 1..146: note = chr7:19152145-19152291
  misc_feature 1..146: note = Hyper
  source 1..146: mol_type = genomic DNA
ctagcagcggccagacgcggggctgggggccttccacgcaaaccgaaggagatacggacatcgtcattctccccaccgcgcgagccgggcccgccacccacgcaggggagaccgtgcccgtgcccctctcccgcgcctgccgcagg

SEQ ID NO: 127363 - DNA, 681 bp, Homo sapiens
  misc_feature 1..681: note = chr7:19155963-19156644
  misc_feature 1..681: note = Hyper
  source 1..681: mol_type = genomic DNA
acaaaaattgaaagccgaaagaaagggtggcgctgacaaaacggtccttacccgtgaccctgggtgtctctgtctcccctcctgtcacgcacactcacgcgcacacacacccctcaccagggcgcatccccctggagactgctctccctagcggggtcagaccggccttccggggacgctgggggcgcgaggcaacggtgccaagtgaggtgggaaggctgagcggagagtgggagaggggaggaaatcgaggtggactgggaaccgcggcctggccggcctgccgtctgccacctgagaggcgaaggggtgcagcggcgcggtccttacctaggtctccggccctgctgagggggtggggggctccgcctgctagtgggacgcggacatggaccaggccccctccatcctccagaccgagaaggcgtagctgagccgctcgtgagccacatagctgcagcttgccatcttggagtccagctcgtcgctctggaggacctggtagaggaagtcgatgtacctggccgccagcttgagggtctgaatcttgctcagcttgtccgagggcagcgtggggatgatcttccgcagcgcggcgaacgcctcgttcagcgactgggtgcgctggcgctcccgcacgttggccatgacccgctgcgtctgcagctcctcgtaagactg

SEQ ID NO: 127364 - DNA, 1520 bp, Homo sapiens
  misc_feature 1..1520: note = chr7:19156704-19158224
  misc_feature 1..1520: note = Hyper
  source 1..1520: mol_type = genomic DNA
gcccgcagacttcttgccgcgcttgccctgggccgggctgcccggctcgtcgccgcctccgacgcccccacccgcggctccgccgggccccgcgccgccgcccgcgctgcgcctgctgctgcgccgcttgcgtcccccgcgcttgccgctcggcggctgctgccggtctggctcttcctcgctgttgctcaggctgtcgtcggccggcgagactggcgagctggacacgtcctgcatcatctctcgagcggcgacgcgtggcctcgcgggcccggggcagaggagaagagcggggcgcctcagcccgccagcttcccccgcgcgcggcgccggcccgggcgatgcggcccgcggaggagagagcaggaggacggacgggagggacctccgcggggagggcgcgcgggggaggcggggagggaggcgggagggggaggggacggtgtggatggccccgaggtccaaaaagaaagcgcccaacggctggacgcacaccccgccaggcctcctggaaacggtgccggtgctgcagagcccgcgaggtgtctgggagttgggcgagagctgcagacttggaggctcttatacctccgtgcaggcggaaagtttgggggcagcagtgtcattggcctgacgtgaggaggagggacttttcgaagttttataggaaagtttccgctttccagtccccctcccccgtcccacctcccttcctcggggtctaacaattcgtcctcccaaaccattcaaaaacgacctggcccgggcggccggcccctccacccgcctcctagccgccctcccccttccctccccgtcgccttcctccggcgggcgcggggcgatttccttccccgccggagcgtgcgggcagcgcccccgaaccctagcgcagcccaggaagcggtcggaggagactgtcctggccgcggtggcagccccatccggagtggctgtgacagcagcaatggcaacagcttctacacagtgggtgatgtctcatctcgcccaagagccctctaggtccgtggggccgatttgggattgctggggctgggggggtggtgtggcgcggggtgggggggcatgccaagaaaagtgtcaaccgcggagcccacccaatggtcaggtagacgaaccccttggagttccaaaggccaaaccgcggcggcccagcccggaggtcctgggcgtttctgaagacgtggccgcgccgcgggggctgaggatttgcgtcccggcctgctctctcgcccttctgggccctcctttcccctctacaacgacccagtctgacgctccccaacatccaaaggactacgcctcggaaggtgctcgaaagaggcagaagttcactcttcggtggaaggaaacccagtccatgggaaaggcagcagagccagaggggggcagcgcagcgcctttgctgcggccctaacagctggcaatgccaacccaagggagagaccctgtggccatttcatccccacccccaaattaggctccgcattgtgaccttg

SEQ ID NO: 127365 - DNA, 99 bp, Homo sapiens; identical to SEQ ID NO: 97148
  misc_feature 1..99: note = chr7:19183647-19183746
  misc_feature 1..99: note = Hyper
  source 1..99: mol_type = genomic DNA

SEQ ID NO: 127366 - DNA, 968 bp, Homo sapiens
  misc_feature 1..968: note = chr7:19184058-19185026
  misc_feature 1..968: note = Hyper
  source 1..968: mol_type = genomic DNA
caggctttttaaaaacgtaagaatttctactttattatctctatgaaaaaaaaaatgtaaagaagagaggttagattttatagaagctccaaagtctgccatttgcgaggagggttcacttcccacccacccagcccacggaagctcttaggagcagcctgaacggccccgactcagcctcacgctctctgacttccccgctcgcccctgaccccgacttcacttagggcggtcgcgtagatatgaactctacagcagccactctgctcagcgcatgtggggatcttacaatctcgaccccgacctccagaagaccagacgttctgtcttggggcctccctcccggccctttagcctcacccagtgcccggtcctgacacaccccagcactaccagacgaggaagggcagactctccacaccaggctcagccgctttccttcttctcacagctctccaagagctcggtcatgaaggagatatagacgatggccaggcggagggtctcgatccgggacagccttttctcgtaagcaaacgtgggcaccttcctccgcagctggtcaaaggcctcgttgaggttgaacatccgcttcctttcgcggatgttggcggcctggcgctgggcgtaggtgatcacccttttcctcttggggcggcctaatagggagacacctcttccgcgctcctcttcctcctcctcttctccgtccccctggtccacttcgcactcctcttcttctgggtccccctcttcaaaccgcgccatcctcctgggtcttccctctcggagcgcaagggctgggtcccccaaggagaccccgggtgcgaagtcgcagaggagagggcgtctcggggaggccagggacaggtctgcgacgaagtccagcaccgtagtgtccacgcagctctccggataggccgccatcgcttcggcttggccctgcctctcatcggttttccgcaggg

SEQ ID NO: 127367 - DNA, 30 bp, Homo sapiens; identical to SEQ ID NO: 97159
  misc_feature 1..30: note = chr7:19813245-19813275
  misc_feature 1..30: note = Hyper
  source 1..30: mol_type = genomic DNA

SEQ ID NO: 127368 - DNA, 24 bp, Homo sapiens
  misc_feature 1..24: note = chr7:20710238-20710262
  misc_feature 1..24: note = Hypo
  source 1..24: mol_type = genomic DNA
aagaagcaagctggccgggtgcgg

SEQ ID NO: 127369 - DNA, 44 bp, Homo sapiens; identical to SEQ ID NO: 97164
  misc_feature 1..44: note = chr7:20719837-20719881
  misc_feature 1..44: note = Hypo
  source 1..44: mol_type = genomic DNA

SEQ ID NO: 127370 - DNA, 139 bp, Homo sapiens; identical to SEQ ID NO: 41210
  misc_feature 1..139: note = chr7:20720174-20720313
  misc_feature 1..139: note = Hypo
  source 1..139: mol_type = genomic DNA

SEQ ID NO: 127371 - DNA, 30 bp, Homo sapiens; identical to SEQ ID NO: 97166
  misc_feature 1..30: note = chr7:20756837-20756867
  misc_feature 1..30: note = Hypo
  source 1..30: mol_type = genomic DNA

SEQ ID NO: 127372 - DNA, 16 bp, Homo sapiens
  misc_feature 1..16: note = chr7:20757821-20757837
  misc_feature 1..16: note = Hypo
  source 1..16: mol_type = genomic DNA
gcgcctggcccaaata

SEQ ID NO: 127373 - DNA, 324 bp, Homo sapiens; identical to SEQ ID NO: 97168
  misc_feature 1..324: note = chr7:20816252-20816576
  misc_feature 1..324: note = Hyper
  source 1..324: mol_type = genomic DNA

SEQ ID NO: 127374 - DNA, 83 bp, Homo sapiens; identical to SEQ ID NO: 31085
  misc_feature 1..83: note = chr7:20817170-20817253
  misc_feature 1..83: note = Hyper
  source 1..83: mol_type = genomic DNA

SEQ ID NO: 127375 - DNA, 754 bp, Homo sapiens
  misc_feature 1..754: note = chr7:20817537-20818291
  misc_feature 1..754: note = Hyper
  source 1..754: mol_type = genomic DNA
gaggccctaggatggcgcagggcagcgggctggtgcgggaaaactacagagcaagcgagggagggaagcgaaggcaggggaatccctcaccccgtccggcccgagtgtcttttgagagcccacaggcgagcggggcggggggaggctccccgcgcattcccaccgtgggtttgcccaaggtcagaggcccgggactggcggggcgggtctggccggcattgcccgcgctgagcgcgctgcagaacgggagcagggcacagggtggcgctcgctgtccgtgcagcgggcggaggcggccgcggtgcctttgtgtgcggtgggcgcggcgatgggctgctccggcccgcagcccgaggggagcggcgggcccgggccggggccagggctcgcggggagaccccagaccaccacctcactcttcgctgctacgtgcaagcggaccgtgcggatcgccagttcggaaccctccccgggagggccccggggtctttctcaatgtactgggcacttcgaggagctgggaagaggaaagcggagggtagcgtttagaaagggagggaaatcctcccaggctcaaaacctctcgcagaattcattcgaaaagagaacgaagggaactttgggcaggccggacctcggctcagcgccctgcgagagaagcagaggtcgctgccagcgtttcctcccgcgcagcaagaaattggtgcctgagaagcaaagttgaggaatgggctttttaaaagcggcagcccca

SEQ ID NO: 127376 - DNA, 2074 bp, Homo sapiens
  misc_feature 1..2074: note = chr7:20823186-20825260
  misc_feature 1..2074: note = Hyper
  source 1..2074: mol_type = genomic DNA
tgctgaaacttgcatcggttccacctcagggaacaaagaaaaagaggcagactgacattgggagatctaaactctacaaactctgggtctcgggctgccaaaagtcacccccaccaagccccgacagcctgagtaggacgtccggcgatgcccaggggcctggcagggtgctccgaagccgaggtgctcagtacagcggctctggaaccaagcagccgtctgcccgggcggcgctgttctgcccaggcctccagcctctccctctccaccgctccgctcaggcttgtcagccgagccgctcctgcccgcgcgaggcccgctgtctaccaggcactggattagtccagctctacctccagtggccgttccctctaaaagttacgcccttcacaacctggggggtggaggaggggaggacaaggaagagagaacgagaaataaaggcccgacgaggcgcgggttccggctgcaacgggttcaggcagcgttacccgtggaaagggaaagccagggcccgggacagcgatgcgtgttacttacttgtccatatcccctttacaaagttaagtcacagaaggaagaaggaagaggggcagaaacagaaagagacagagagcgagtcggatgcaatagggaaaggctggagttgaagtccggacagacagggcccaagaggacttggtgggaggaggtcggggagaggggcgggcgcagggtgggcgtcactctaggccgttgcggtgcccgggctcggggggctgcagcagctctggggagtggcagggcgggctgcccgcggcgctgtgctcgctgtcggtgtcgctgcccttcttgccgccgctgcccgagcccgccgagccgccgccgccgccgccgccactgtgcgtcttcacgtgcttgctgaggtggtcgctgcgcatgaagcgcttgttgcaaactggacaggcgaagcgcttctcgccggtgtgggtccgcaggtgccgctgcagctcgtcggagcgcgtgaagcgcttgccgcagaaaagccagttgcacacgaagggccgctcgcccgtgtgccagcgcaggtgcgccttgaggtgcgaagtcttgccgtacaccttgccgcagcccgggatgtggcagctgtgcaggcccttgcgccgcaagctcgccccggcagggcccagccgctctgcctcctggcagttggggcagtcgcaggtggcgcggccggagtagcggcgagctgaggagcgcggggagccccccagcggcgccgaaggcccagcgctcaacatggagccccccgcgccggccagcggcgacggggccgagtccgggtaggagccgggtagcactggcttgaagccgtccatgaggtgctgcccggcggggctgagcaggtgcgaggaggcgccgctgctgaaggccgagtgactcaggcccgagtaatccgagttgtagcctccgagcggcgagtgcagcgaggtttggagccccccggcggcagggtgcagcgagccgggcagcgcagccgcgctgttcgggttctgcacgtcgatccagccggcccccacgtcccaccagctggaggcgccggccgagcccacctcgcccgcagcacccaggcccgggtgcgagggcttaaaccacgactcgtacgggtgcgccatgcccacccgcgggtagatgccctgcagcccgtccacagaggtgtgcaccttggagatgaacaccggctggtgggagccgtcctgcgagtgcgcggaggagccgccgccgccgcccccgccgccgccgccgctgcccccggaaactccgggggcctggaaaacagagtagtcgttggcgaagggcgagctggaggcggcggctgcggcggcggcggcggcggctgcggcgctgctggaggtgagggagaaggcgctggagccaggcgagccgccgcagctgaacgagtcggacaccagggccgcggcagccgcggctgctgccgcggccgccgcagccgccgaggacgagccgccgttcctggaggccccggacacgccgaagcttgagagactggaacccactacgttgcagctggcgg

SEQ ID NO: 127377 - DNA, 339 bp, Homo sapiens; identical to SEQ ID NO: 97177
  misc_feature 1..339: note = chr7:20826499-20826838
  misc_feature 1..339: note = Hyper
  source 1..339: mol_type = genomic DNA

SEQ ID NO: 127378 - DNA, 155 bp, Homo sapiens; identical to SEQ ID NO: 97178
  misc_feature 1..155: note = chr7:20827308-20827463
  misc_feature 1..155: note = Hyper
  source 1..155: mol_type = genomic DNA

SEQ ID NO: 127379 - DNA, 34 bp, Homo sapiens; identical to SEQ ID NO: 97179
  misc_feature 1..34: note = chr7:20827523-20827557
  misc_feature 1..34: note = Hyper
  source 1..34: mol_type = genomic DNA

SEQ ID NO: 127380 - DNA, 111 bp, Homo sapiens; identical to SEQ ID NO: 97180
  misc_feature 1..111: note = chr7:20828484-20828595
  misc_feature 1..111: note = Hyper
  source 1..111: mol_type = genomic DNA

SEQ ID NO: 127381 - DNA, 779 bp, Homo sapiens; identical to SEQ ID NO: 97181
  misc_feature 1..779: note = chr7:20830608-20831387
  misc_feature 1..779: note = Hyper
  source 1..779: mol_type = genomic DNA

SEQ ID NO: 127382 - DNA, 454 bp, Homo sapiens; identical to SEQ ID NO: 97182
  misc_feature 1..454: note = chr7:20833089-20833543
  misc_feature 1..454: note = Hyper
  source 1..454: mol_type = genomic DNA

SEQ ID NO: 127383 - DNA, 84 bp, Homo sapiens; identical to SEQ ID NO: 97183
  misc_feature 1..84: note = chr7:20834292-20834376
  misc_feature 1..84: note = Hyper
  source 1..84: mol_type = genomic DNA

SEQ ID NO: 127384 - DNA, 54 bp, Homo sapiens; identical to SEQ ID NO: 97184
  misc_feature 1..54: note = chr7:20834576-20834630
  misc_feature 1..54: note = Hyper
  source 1..54: mol_type = genomic DNA

SEQ ID NO: 127385 - DNA, 30 bp, Homo sapiens; identical to SEQ ID NO: 8910
  misc_feature 1..30: note = chr7:20836099-20836129
  misc_feature 1..30: note = Hyper
  source 1..30: mol_type = genomic DNA

SEQ ID NO: 127386 - DNA, 218 bp, Homo sapiens; identical to SEQ ID NO: 97186
  misc_feature 1..218: note = chr7:20836779-20836997
  misc_feature 1..218: note = Hyper
  source 1..218: mol_type = genomic DNA

SEQ ID NO: 127387 - DNA, 50 bp, Homo sapiens; identical to SEQ ID NO: 8912
  misc_feature 1..50: note = chr7:20838460-20838510
  misc_feature 1..50: note = Hyper
  source 1..50: mol_type = genomic DNA

SEQ ID NO: 127388 - DNA, 30 bp, Homo sapiens; identical to SEQ ID NO: 97189
  misc_feature 1..30: note = chr7:20930367-20930397
  misc_feature 1..30: note = Hypo
  source 1..30: mol_type = genomic DNA

SEQ ID NO: 127389 - DNA, 30 bp, Homo sapiens; identical to SEQ ID NO: 97190
  misc_feature 1..30: note = chr7:21006501-21006531
  misc_feature 1..30: note = Hypo
  source 1..30: mol_type = genomic DNA

SEQ ID NO: 127390 - DNA, 280 bp, Homo sapiens; identical to SEQ ID NO: 97193
  misc_feature 1..280: note = chr7:21370232-21370512
  misc_feature 1..280: note = Hypo
  source 1..280: mol_type = genomic DNA

SEQ ID NO: 127391 - DNA, 30 bp, Homo sapiens; identical to SEQ ID NO: 97194
  misc_feature 1..30: note = chr7:21400528-21400558
  misc_feature 1..30: note = Hypo
  source 1..30: mol_type = genomic DNA

SEQ ID NO: 127392 - DNA, 932 bp, Homo sapiens
  misc_feature 1..932: note = chr7:21582520-21583452
  misc_feature 1..932: note = Hyper
  source 1..932: mol_type = genomic DNA
tcgggacctagagcccgagggcctctcccctcggccttggccttggcgtatactgggcggtggcgcggtgcgctcactccgcccccagcgggctggggcggggacaccgtcccccgggaaacgggacgcgctgcttgtcccaggccttcgcttcggcctgcgaggctacagctgtgcgcagtggcgcggctgctaagtagcagcaggtgggagactagggtctgcgctcgcggcgaccgcggaggagggtgggcgcctgcggaggtgtcctcgctcacttcggggggcccagagtctcgggtgaggagccagccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggaggtaagaggcgacgggcaaggggacctgcccatccaacaaaactacccaggggagacagcccagtcgctcccctttggattcccgcggggcgctcactcgggcactttaacaaacttggcttgaagtccccatcctgaggcccgcaggactcctccccacgtgcacccactctgcagttcagcagctgcaggttagtttcctaagtcagcagtttgtatctgaccgagaatcccgcgtt

SEQ ID NO: 127393 - DNA, 57 bp, Homo sapiens; identical to SEQ ID NO: 97199
  misc_feature 1..57: note = chr7:21690874-21690931
  misc_feature 1..57: note = Hypo
  source 1..57: mol_type = genomic DNA

SEQ ID NO: 127394 - DNA, 95 bp, Homo sapiens; identical to SEQ ID NO: 97206
  misc_feature 1..95: note = chr7:22539833-22539928
  misc_feature 1..95: note = Hyper
  source 1..95: mol_type = genomic DNA

SEQ ID NO: 127395 - DNA, 28 bp, Homo sapiens
  misc_feature 1..28: note = chr7:22540572-22540600
  misc_feature 1..28: note = Hypo
  source 1..28: mol_type = genomic DNA
gcgtgagccaccgcgcccagccacctta

SEQ ID NO: 127396 - DNA, 657 bp, Homo sapiens; identical to SEQ ID NO: 97208
  misc_feature 1..657: note = chr7:22589295-22589952
  misc_feature 1..657: note = Hyper
  source 1..657: mol_type = genomic DNA

SEQ ID NO: 127397 - DNA, 30 bp, Homo sapiens; identical to SEQ ID NO: 97211
  misc_feature 1..30: note = chr7:22893577-22893607
  misc_feature 1..30: note = Hyper
  source 1..30: mol_type = genomic DNA

SEQ ID NO: 127398 - DNA, 173 bp, Homo sapiens; identical to SEQ ID NO: 41212
  misc_feature 1..173: note = chr7:22981026-22981199
  misc_feature 1..173: note = Hypo
  source 1..173: mol_type = genomic DNA

SEQ ID NO: 127399 - DNA, 30 bp, Homo sapiens; identical to SEQ ID NO: 97214
  misc_feature 1..30: note = chr7:23009058-23009088
  misc_feature 1..30: note = Hypo
  source 1..30: mol_type = genomic DNA

SEQ ID NO: 127400 - DNA, 53 bp, Homo sapiens; identical to SEQ ID NO: 97215
  misc_feature 1..53: note = chr7:23053027-23053080
  misc_feature 1..53: note = Hyper
  source 1..53: mol_type = genomic DNA

SEQ ID NO: 127401 - DNA, 16 bp, Homo sapiens
  misc_feature 1..16: note = chr7:23129478-23129494
  misc_feature 1..16: note = Hypo
  source 1..16: mol_type = genomic DNA
ccgtctcaaaaaaaaa

SEQ ID NO: 127402 - DNA, 30 bp, Homo sapiens; identical to SEQ ID NO: 41213
  misc_feature 1..30: note = chr7:23220685-23220715
  misc_feature 1..30: note = Hypo
  source 1..30: mol_type = genomic DNA

SEQ ID NO: 127403 - DNA, 78 bp, Homo sapiens; identical to SEQ ID NO: 97218
  misc_feature 1..78: note = chr7:23223070-23223148
  misc_feature 1..78: note = Hypo
  source 1..78: mol_type = genomic DNA

SEQ ID NO: 127404 - DNA, 448 bp, Homo sapiens
  misc_feature 1..448: note = chr7:23287206-23287654
  misc_feature 1..448: note = Hyper
  source 1..448: mol_type = genomic DNA
agcagtgtgcagattcgcgagaggaagagagctgagccgctgtaaccctgggcctgggattgcggggacgggacgggtgggaagcggccaaaggcgcagcggcttctggtcagagccgcagaggcctgagacgtgggccgcgccccggcccaggagaccccgcggccgcgccctaaccctcagtctcccgactgcgactgcgacccgggaaaacgcctacgtttttggaaaggaagtcccatcacagggagctgacccggtgtcagcgcgcagcacgttcccggcccgcagtgcgccgcgcgtcctcctagcagcccgcggagcccggcactgtgatggtcccgcttcccacacgaggccacgggccacagagtgggcaaggaactcgccccaagccacacagcgggtaagttgaggaggcagccttccatcccgacctctgtccttc

SEQ ID NO: 127405 - DNA, 30 bp, Homo sapiens; identical to SEQ ID NO: 97221
  misc_feature 1..30: note = chr7:23340392-23340422
  misc_feature 1..30: note = Hypo
  source 1..30: mol_type = genomic DNA

SEQ ID NO: 127406 - DNA, 1745 bp, Homo sapiens; identical to SEQ ID NO: 97223
  misc_feature 1..1745: note = chr7:23508102-23509847
  misc_feature 1..1745: note = Hyper
  source 1..1745: mol_type = genomic DNA

SEQ ID NO: 127407 - DNA, 183 bp, Homo sapiens; identical to SEQ ID NO: 97224
  misc_feature 1..183: note = chr7:23510841-23511024
  misc_feature 1..183: note = Hyper
  source 1..183: mol_type = genomic DNA

SEQ ID NO: 127408 - DNA, 951 bp, Homo sapiens; identical to SEQ ID NO: 97225
  misc_feature 1..951: note = chr7:23513474-23514425
  misc_feature 1..951: note = Hyper
  source 1..951: mol_type = genomic DNA

SEQ ID NO: 127409 - DNA, 136 bp, Homo sapiens; identical to SEQ ID NO: 97226
  misc_feature 1..136: note = chr7:23514666-23514802
  misc_feature 1..136: note = Hyper
  source 1..136: mol_type = genomic DNA

SEQ ID NO: 127410 - DNA, 33 bp, Homo sapiens; identical to SEQ ID NO: 97227
  misc_feature 1..33: note = chr7:23525018-23525051
  misc_feature 1..33: note = Hypo
  source 1..33: mol_type = genomic DNA

SEQ ID NO: 127411 - DNA, 30 bp, Homo sapiens; identical to SEQ ID NO: 97228
  misc_feature 1..30: note = chr7:23553199-23553229
  misc_feature 1..30: note = Hypo
  source 1..30: mol_type = genomic DNA

SEQ ID NO: 127412 - DNA, 30 bp, Homo sapiens; identical to SEQ ID NO: 41215
  misc_feature 1..30: note = chr7:23568103-23568133
  misc_feature 1..30: note = Hypo
  source 1..30: mol_type = genomic DNA

SEQ ID NO: 127413 - DNA, 138 bp, Homo sapiens; identical to SEQ ID NO: 97230
  misc_feature 1..138: note = chr7:23569163-23569301
  misc_feature 1..138: note = Hypo
  source 1..138: mol_type = genomic DNA

SEQ ID NO: 127414 - DNA, 34 bp, Homo sapiens; identical to SEQ ID NO: 97231
  misc_feature 1..34: note = chr7:23578823-23578857
  misc_feature 1..34: note = Hypo
  source 1..34: mol_type = genomic DNA

SEQ ID NO: 127415 - DNA, 125 bp, Homo sapiens; identical to SEQ ID NO: 97232
  misc_feature 1..125: note = chr7:23719533-23719658
  misc_feature 1..125: note = Hyper
  source 1..125: mol_type = genomic DNA

SEQ ID NO: 127416 - DNA, 123 bp, Homo sapiens; identical to SEQ ID NO: 97233
  misc_feature 1..123: note = chr7:23749706-23749829
  misc_feature 1..123: note = Hypo
  source 1..123: mol_type = genomic DNA

SEQ ID NO: 127417 - DNA, 120 bp, Homo sapiens; identical to SEQ ID NO: 41219
  misc_feature 1..120: note = chr7:24099277-24099397
  misc_feature 1..120: note = Hypo
  source 1..120: mol_type = genomic DNA

SEQ ID NO: 127418 - DNA, 30 bp, Homo sapiens; identical to SEQ ID NO: 97236
  misc_feature 1..30: note = chr7:24323498-24323528
  misc_feature 1..30: note = Hyper
  source 1..30: mol_type = genomic DNA

SEQ ID NO: 127419 - DNA, 60 bp, Homo sapiens; identical to SEQ ID NO: 97237
  misc_feature 1..60: note = chr7:24324091-24324151
  misc_feature 1..60: note = Hyper
  source 1..60: mol_type = genomic DNA

SEQ ID NO: 127420 - DNA, 21 bp, Homo sapiens
  misc_feature 1..21: note = chr7:24580785-24580806
  misc_feature 1..21: note = Hypo
  source 1..21: mol_type = genomic DNA
ccttcgcgcccagccacaatc

SEQ ID NO: 127421 - DNA, 61 bp, Homo sapiens; identical to SEQ ID NO: 97240
  misc_feature 1..61: note = chr7:24749659-24749720
  misc_feature 1..61: note = Hypo
  source 1..61: mol_type = genomic DNA

SEQ ID NO: 127422 - DNA, 224 bp, Homo sapiens; identical to SEQ ID NO: 41221
  misc_feature 1..224: note = chr7:24761204-24761428
  misc_feature 1..224: note = Hypo
  source 1..224: mol_type = genomic DNA

SEQ ID NO: 127423 - DNA, 180 bp, Homo sapiens; identical to SEQ ID NO: 97242
  misc_feature 1..180: note = chr7:24771552-24771732
  misc_feature 1..180: note = Hypo
  source 1..180: mol_type = genomic DNA

SEQ ID NO: 127424 - DNA, 1278 bp, Homo sapiens
  misc_feature 1..1278: note = chr7:24796332-24797610
  misc_feature 1..1278: note = Hyper
  source 1..1278: mol_type = genomic DNA
ccctcggggtgcagacggcaagcggctctggaaagggtcagaggtcctcaaatggagaccaaaggaagccacgcgggcagctcttgagagccattccagcgcatgccaggcacaccgagtggggcttggcctcctccccaagctaggagctctctagataccggagcaaagtggagggggacttttttccgtccagagagactgaactccgtatctgttccgcggtccgcctccctgcacacacgcccccgagccgggagagcctccgcagcacccagagaagagaccggaacacaaaggatgaacgaatggggagggggggtttggggggttgggagaacgaaaataccagctgcgcttccaacatccaaggaaggaagtggcagcggggacggggagaggatgggaaggggatgctgactgcgagttggggcgggacgcggtgatgggaggggaccgggccgggaatgcgggaggcgaggggagcgacgggacctgccgttccggcggccgggcagccaatcgattcgtctcccctaggaaggagcgaggggagggtggcccagagagaaagcgccgcgcggcctcggctgcccccggcccgggacacccaaacagaccaaagaggatccggagtggagcccggagcggatcccgcagcccgcgcccgccgcgcacttacccgcgcgcccgctgctgggtccccggcagccgcgccccctgcgctggcggagtcggaggagcctgcgctgggccggcggggggcgggcgcttggggagggcggagagagggcccgcccgccgggacctttgctcggtccgggcgccccagagccgcgggactggccgccggaggctgcgggaggggcccgggccagacctcccagaagccccagagagagccgcttcccctccttcgtgtgactctctgggagccgggttgctgacggcccagcgctcagccggagtccccgcgcgcttttcgggactcacccgggagatgtcggggcctctcgggaagagtgggctgcgcctgccttccgcggccgcctcgcctcttcgctgcgcgggaccgtggggtttgagagcggcgcctcctcgcggggccgaacccgccacccacagtggagtgtggactgacaccgcggcctcacggttcaaccaggaaagtccaaggcctgtccagcctgtgggagcccctaatgcccgtgcctggagtagtatctgggtgtgtggtgcgacagtgcccacacttaggcctgccgctaatcagtgatt

SEQ ID NO: 127425 - DNA, 30 bp, Homo sapiens; identical to SEQ ID NO: 41222
  misc_feature 1..30: note = chr7:24799881-24799911
  misc_feature 1..30: note = Hypo
  source 1..30: mol_type = genomic DNA

SEQ ID NO: 127426 - DNA, 30 bp, Homo sapiens; identical to SEQ ID NO: 41223
  misc_feature 1..30: note = chr7:24845483-24845513
  misc_feature 1..30: note = Hypo
  source 1..30: mol_type = genomic DNA

SEQ ID NO: 127427 - DNA, 124 bp, Homo sapiens; identical to SEQ ID NO: 97251
  misc_feature 1..124: note = chr7:25100258-25100382
  misc_feature 1..124: note = Hypo
  source 1..124: mol_type = genomic DNA

SEQ ID NO: 127428 - DNA, 42 bp, Homo sapiens; identical to SEQ ID NO: 97252
  misc_feature 1..42: note = chr7:25132402-25132444
  misc_feature 1..42: note = Hypo
  source 1..42: mol_type = genomic DNA

SEQ ID NO: 127429 - DNA, 31 bp, Homo sapiens; identical to SEQ ID NO: 97253
  misc_feature 1..31: note = chr7:25133418-25133449
  misc_feature 1..31: note = Hypo
  source 1..31: mol_type = genomic DNA

SEQ ID NO: 127430 - DNA, 120 bp, Homo sapiens; identical to SEQ ID NO: 97255
  misc_feature 1..120: note = chr7:25165828-25165948
  misc_feature 1..120: note = Hypo
  source 1..120: mol_type = genomic DNA

SEQ ID NO: 127431 - DNA, 197 bp, Homo sapiens; identical to SEQ ID NO: 97256
  misc_feature 1..197: note = chr7:25335888-25336085
  misc_feature 1..197: note = Hypo
  source 1..197: mol_type = genomic DNA

SEQ ID NO: 127432 - DNA, 190 bp, Homo sapiens; identical to SEQ ID NO: 41224
  misc_feature 1..190: note = chr7:25495487-25495677
  misc_feature 1..190: note = Hypo
  source 1..190: mol_type = genomic DNA

SEQ ID NO: 127433 - DNA, 84 bp, Homo sapiens; identical to SEQ ID NO: 41225
  misc_feature 1..84: note = chr7:25530809-25530893
  misc_feature 1..84: note = Hypo
  source 1..84: mol_type = genomic DNA

SEQ ID NO: 127434 - DNA, 30 bp, Homo sapiens; identical to SEQ ID NO: 97261
  misc_feature 1..30: note = chr7:25569127-25569157
  misc_feature 1..30: note = Hypo
  source 1..30: mol_type = genomic DNA

SEQ ID NO: 127435 - DNA, 20 bp, Homo sapiens
  misc_feature 1..20: note = chr7:25603450-25603470
  misc_feature 1..20: note = Hypo
  source 1..20: mol_type = genomic DNA
gatttgggccaggtgcggtg

SEQ ID NO: 127436 - DNA, 186 bp, Homo sapiens; identical to SEQ ID NO: 41226
  misc_feature 1..186: note = chr7:25802276-25802462
  misc_feature 1..186: note = Hypo
  source 1..186: mol_type = genomic DNA

SEQ ID NO: 127437 - DNA, 297 bp, Homo sapiens; identical to SEQ ID NO: 31119
  misc_feature 1..297: note = chr7:25891946-25892243
  misc_feature 1..297: note = Hyper
  source 1..297: mol_type = genomic DNA

SEQ ID NO: 127438 - DNA, 78 bp, Homo sapiens
  misc_feature 1..78: note = chr7:25892510-25892588
  misc_feature 1..78: note = Hyper
  source 1..78: mol_type = genomic DNA
ccctcgccctgggaccgttgcccctgcgcccgccgccctgtgcctgggcctttgcacccggagcgccccgcgccccag

SEQ ID NO: 127439 - DNA, 384 bp, Homo sapiens; identical to SEQ ID NO: 97270
  misc_feature 1..384: note = chr7:25896230-25896614
  misc_feature 1..384: note = Hyper
  source 1..384: mol_type = genomic DNA

SEQ ID NO: 127440 - DNA, 264 bp, Homo sapiens; identical to SEQ ID NO: 97271
  misc_feature 1..264: note = chr7:25896674-25896938
  misc_feature 1..264: note = Hyper
  source 1..264: mol_type = genomic DNA

SEQ ID NO: 127441 - DNA, 32 bp, Homo sapiens; identical to SEQ ID NO: 97272
  misc_feature 1..32: note = chr7:25902106-25902138
  misc_feature 1..32: note = Hyper
  source 1..32: mol_type = genomic DNA

SEQ ID NO: 127442 - DNA, 304 bp, Homo sapiens; identical to SEQ ID NO: 31122
  misc_feature 1..304: note = chr7:25902345-25902649
  misc_feature 1..304: note = Hyper
  source 1..304: mol_type = genomic DNA

SEQ ID NO: 127443 - DNA, 218 bp, Homo sapiens; identical to SEQ ID NO: 97274
  misc_feature 1..218: note = chr7:25990010-25990228
  misc_feature 1..218: note = Hyper
  source 1..218: mol_type = genomic DNA

SEQ ID NO: 127444 - DNA, 63 bp, Homo sapiens; identical to SEQ ID NO: 97276
  misc_feature 1..63: note = chr7:26192685-26192748
  misc_feature 1..63: note = Hyper
  source 1..63: mol_type = genomic DNA

SEQ ID NO: 127445 - DNA, 40 bp, Homo sapiens; identical to SEQ ID NO: 97277
  misc_feature 1..40: note = chr7:26217186-26217226
  misc_feature 1..40: note = Hypo
  source 1..40: mol_type = genomic DNA

SEQ ID NO: 127446 - DNA, 17 bp, Homo sapiens
  misc_feature 1..17: note = chr7:26222458-26222475
  misc_feature 1..17: note = Hypo
  source 1..17: mol_type = genomic DNA
gctggagtgtggcagcg

SEQ ID NO: 127447 - DNA, 120 bp, Homo sapiens; identical to SEQ ID NO: 97279
  misc_feature 1..120: note = chr7:26283695-26283815
  misc_feature 1..120: note = Hypo
  source 1..120: mol_type = genomic DNA

SEQ ID NO: 127448 - DNA, 781 bp, Homo sapiens; identical to SEQ ID NO: 97280
  misc_feature 1..781: note = chr7:26415774-26416555
  misc_feature 1..781: note = Hyper
  source 1..781: mol_type = genomic DNA

SEQ ID NO: 127449 - DNA, 37 bp, Homo sapiens; identical to SEQ ID NO: 97281
  misc_feature 1..37: note = chr7:26437864-26437901
  misc_feature 1..37: note = Hyper
  source 1..37: mol_type = genomic DNA

SEQ ID NO: 127450 - DNA, 30 bp, Homo sapiens; identical to SEQ ID NO: 97282
  misc_feature 1..30: note = chr7:26439820-26439850
  misc_feature 1..30: note = Hypo
  source 1..30: mol_type = genomic DNA

SEQ ID NO: 127451 - DNA, 23 bp, Homo sapiens
  misc_feature 1..23: note = chr7:26513167-26513190
  misc_feature 1..23: note = Hypo
  source 1..23: mol_type = genomic DNA
agttttgatattggtcgggggca

SEQ ID NO: 127452 - DNA, 81 bp, Homo sapiens; identical to SEQ ID NO: 97285
  misc_feature 1..81: note = chr7:26555405-26555486
  misc_feature 1..81: note = Hypo
  source 1..81: mol_type = genomic DNA

SEQ ID NO: 127453 - DNA, 165 bp, Homo sapiens; identical to SEQ ID NO: 97287
  misc_feature 1..165: note = chr7:26652551-26652716
  misc_feature 1..165: note = Hypo
  source 1..165: mol_type = genomic DNA

SEQ ID NO: 127454 - DNA, 35 bp, Homo sapiens; identical to SEQ ID NO: 41231
  misc_feature 1..35: note = chr7:26762298-26762333
  misc_feature 1..35: note = Hypo
  source 1..35: mol_type = genomic DNA

SEQ ID NO: 127455 - DNA, 30 bp, Homo sapiens; identical to SEQ ID NO: 97290
  misc_feature 1..30: note = chr7:26979426-26979456
  misc_feature 1..30: note = Hypo
  source 1..30: mol_type = genomic DNA

SEQ ID NO: 127456 - DNA, 44 bp, Homo sapiens; identical to SEQ ID NO: 97292
  misc_feature 1..44: note = chr7:27128016-27128060
  misc_feature 1..44: note = Hyper
  source 1..44: mol_type = genomic DNA

SEQ ID NO: 127457 - DNA, 1524 bp, Homo sapiens
  misc_feature 1..1524: note = chr7:27135266-27136790
  misc_feature 1..1524: note = Hyper
  source 1..1524: mol_type = genomic DNA
acacccccaggttcccggaagtctggtaggtagccggctgggggtggcgatggtggtggtggtggtggtggtggggcgaaccgatctgcacccccctgcccactaggaagcggtcgtcgccgccgcaactgttggcgctgaccgcgcacgactggaaagttgtaatcctatggtccgaggggtaggctcgggctgagcaggtccccgagtcgccactgctaagtatggggtattccaggaaggagttcattcttgcattgtccatctgtcactgagtgacctggtcctgcgaagcccggcgtgactgtgccaactttctcacttcctccatggggccggagaagaaaaatgatatgaatgtacagtgcgcaagagggggggcgggagggcggaggacgctggaggaggggcacgtgacggtgtcagccaatggctgagcctcctgcaaaagtttgccggcttccgcagtgatggatcaccgttttagtggcatttaaatccccggcgctccgccgtctaggtgacgcgcagtcgcccccccaggcagcctaggcggcggcagctgctgcggcgactgcaaaggccgatttggagtgctggagcgaagaagagcaaaagctgcgttctgcgcgcgcccgactccgctgcccgccccgccaggcctccgggaggtgggggctgggaggcgtcccccgctcccgccccctccccaccgttcaatgaaagatgaactggcgagaggtgagaagggaagagggctcccggctctctcggggcgggaatcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggctcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattcgacttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcacagggccggtccacagctccaacatagtagctgaactcccttcgttgcgttcctctttttct

SEQ ID NO: 127458 - DNA, 1128 bp, Homo sapiens; identical to SEQ ID NO: 97297
  misc_feature 1..1128: note = chr7:27190145-27191273
  misc_feature 1..1128: note = Hyper
  source 1..1128: mol_type = genomic DNA

SEQ ID NO: 127459 - DNA, 77 bp, Homo sapiens; identical to SEQ ID NO: 97298
  misc_feature 1..77: note = chr7:27191507-27191584
  misc_feature 1..77: note = Hyper
  source 1..77: mol_type = genomic DNA

SEQ ID NO: 127460 - DNA, 1052 bp, Homo sapiens
  misc_feature 1..1052: note = chr7:27195586-27196638
  misc_feature 1..1052: note = Hyper
  source 1..1052: mol_type = genomic DNA
atgctatgggctccacgcaatggcgcctccgctccaattaaaaccagaaaggctgcgccgggagtcacggggctaccggctcgcaacagcctggctccgctcttccggccccgcgccccgcgctccgcgctccccagcgctgcgctccccgctcccggtcccgctccgccagcctggcccgcctagcgactgcgcctacctgaagaccgcatccaggggtagatgcggaaattggcctcagccgcgccatgcagcgcgccctcgtccgtcttgtcgcaggcgcctttggcgaggtcactgcagagcccggggatgttttggtcgtaggaggcgcagggcaggttgccgtaggcgtcggcgcccaggccgtagccggacgcaaaggggctctgataaagggggctgttgacattgtataagcccggaacggtcgaggcgaaggcgccggcgcccgccccgtagccgcttctctgtgagttgggagcaaaggagcaagaagtcggctcggcattttggaacagagaagcccccgccgtatatttgctaaaaagcgcgttcacataatacgaagaactcataattttgacctgtgatttgttgtccggcagctttcagtgtcggttttacgaggtagagtgatatatgataacattacacccccagatttacaccaaaccccattttcttttggacggagctcgccgcagcacgtgaccgcccacatgaccgcctccgccaatctcagcagtcctcacaggtggtctcgctccgcagggcccgcagccgcctagaatggaagggcaagaggctcaaatatgcggccaaagaatccgcccgcgcccggcgggcctggcgcgtcccgcggaaaaagacctggaggctccgcgggagcgcccagctggcggccaacctccgcactggggtctgcggacgccaggcggcccggccccacgcagcaccccccaccccgcccccccgccgactcctgctagtgagccctggaccaagcttgggatcctccccatccctctcctgtccgcctgcccagaccc

SEQ ID NO: 127461 - DNA, 30 bp, Homo sapiens; identical to SEQ ID NO: 97305
  misc_feature 1..30: note = chr7:27204111-27204141
  misc_feature 1..30: note = Hyper
  source 1..30: mol_type = genomic DNA

SEQ ID NO: 127462 - DNA, 1674 bp, Homo sapiens
  misc_feature 1..1674: note = chr7:27204384-27206058
  misc_feature 1..1674: note = Hyper
  source 1..1674: mol_type = genomic DNA
tcgagaggcttccagcgaggacgaaggcaggctcgagagaaacctggcgggccagcagatccgggaggccggcgtggaggcggcggcggatttgaagggaggagacacttactgggatcgatggggggcttgtctccgccgctctcattctcagcattgttttcagagaaggcgccttcgctgggttgtttttctctatcaactggaggagaaccacaagcatagtcagtcagggacaaagtgtgagtgtcaagcgtgggacagtcaccccttctggccgacagcggttcaggtttaatgccataaggccggctggagggcaagcccgcgaaggagagcgcaccgggcgtgggctccagccaggagcgcatgtacctgccgtccggcgccgccgccgccacgggcgcctgggggtgcacgtaggggtggtggtgatggtggtggtacaccgcagcgggtacagcgttggcgcccgccgcgtgcactgggttccacgaggcgccaaacaccgtcgccttggactggaagctgcacgggctgaagtcggggtgctcggccagcgtcgccgcctgccggggaggctggcccagggtccccggcgcatagcggccaacgctcagctcatccgcggcgtcggcgcccagcaggaacgagtccacgtagtagttgcccagggccccagtggtggccatcaccgtgcccagcgcctggcccgcccggcccgacccacggaaattatgaaactgcagatttcatgtaacaacttggtggcaccgggggggaagtacagtcacctaataagttgccggcgcccgcgcccccattggccgtgcgcgtcacgtgcccgtccagcagaacaataacgcgtaaatcactccgcacgctattaatggtccgatgttttgcagtcataatttttatagcaaaagccatatgtttttatgtaaagggatcgtgccgctctacgatggggtttgttttaattgtggccaacgacgattaaaagatcaaatctagccttgtctctgtactctcccgtctccccccccatacacacacttcttaagcggactattttatatcacaattaatcacgccatcaagaaggcgcgggtcccgcgtgcgagtgcggccagcggagcccctcacataaaattagacaataattgaagccataaaaaagcagccaaatcgcattgtcgctctactgtatttaaatctatatttatgatatttcataaggagttattgtttcagaagccacacaggctggcgggaagtcggaaacgaccaacagattcgtttgcctcgccgtggctcccagctgtaaaaatttacgaggacttggaaaggttagactgttgtgtttggttggcgagctccctgtaaataatccctgcggtccccgggagaggcgagtttacccgcggccgccctcgaaaagtcaaattcaacgcaggatccgtcccaaacggagccgccgccggccctaccagggcactccaggcagggaccggccgctcagggagtaccgcgggtgtaggtccccacagctacccgcctggagcgaggggcgcccgggcaacccttaaattcgcctttgctacgaggaccccacggaggagctggccaggagggagcggccagccgccaccagggcgaaggttttgaggg

SEQ ID NO: 127463 - DNA, 36 bp, Homo sapiens; identical to SEQ ID NO: 97309
  misc_feature 1..36: note = chr7:27208865-27208901
  misc_feature 1..36: note = Hyper
  source 1..36: mol_type = genomic DNA

SEQ ID NO: 127464 - DNA, 178 bp, Homo sapiens; identical to SEQ ID NO: 97310
  misc_feature 1..178: note = chr7:27209503-27209681
  misc_feature 1..178: note = Hyper
  source 1..178: mol_type = genomic DNA

SEQ ID NO: 127465 - DNA, 2050 bp, Homo sapiens
  misc_feature 1..2050: note = chr7:27212347-27214397
  misc_feature 1..2050: note = Hyper
  source 1..2050: mol_type = genomic DNA
atagctgggcgattccgaggtccaggggaagggaaatggcccttctctggctctcagctcagggccccccgcttccaggccggatttgccttttcttcttcccgcaacgaagattcccgcccctcagcaactttgaaaaaagcatgggggatcgtaaactcgaacttcgccggttaatgggcttatttattggcgctggcggctgcttattttggatgccttacaaacatccgcgctatctgcgggcgagctactttccctccctccccctccccccgcgtgggccgcgccgcgcaggctgggcagggaccagggctctgggtcctcccggccacaggaaagagcgcacaggagggggcctgctcgctggtgtcctcgtccctagtcagggggagctgaggccagcgccgaggacgtcttgctgtggggcgctaagccggacatgaattttactgcgtccccacgcccaaatattaaaaagcaagttcacaaggtcagcctgcctgcagcttgggccaaggccggccggctgctgcgcgggctcctagttttctgatccttctcctccttgtgtctgcctgtctgcccgcctgactgcagccctctgcagccctgcttacccagggaatccttctccggcgaggctttgctgctctcggaaggggccggggagagctcctccgcggccgaggacgacgcgtgcgcctcctcgtcgccctgcgagcccccgccgctgccgcaagccagcgtggggggcggcggcgaatcgagggctcgctccttccgggccgcatcggccgagccggaggctagcgcgggcgggagatcgaaaccgcgccccgggggctgcgcggggaacgggccagccccgagttgctgcgcgccgccgccgccgctgccatagcccttggcggtgccgtaggcctgagaaaggcggaagtagccaggcactggcaccccgctggaggtgcccagggcgcagccgtcgggcggcgggccccgcgggaagggagccagttcggcggcggtggccgagactttggggcatttgtccgccgagtcgtagaggcagtaggagctctcttctttgatgttctgcgcgaaagagcacgaggtggcctgcggcgctggctggggtggttgcggcgggggcggcggctgctgctggggcggcggcggcggcccgtcaggcggctccatccggcaagaccggggcgcgtctagccacaggtctatgggcgagggcccgtagccgtgcgccccgggacctagacccccgccaccgccaccgctgcccggcgacgctgcctcattgcgcttgccgcccagcgtggggaagagcccgcagctctgcagcccgtagggcaggtcggcggcgggcggcaggtagaccccgccgtgggcgtagtaaccgccaccgccgccgccccccgcgccaccaccaccgccgcctgcctcgcctctgcccgagctgatgagcgagtcgaccaaaaaagagttcgcggcggggctctccgagcatgacattgttgtgggataatttggcgaagggagcagatagccctttctggctgacatttcttgtgcaaaacatgctgaatacgattagcaatccccccgcaccgcggcgggcgcccgcagccaatcccgagccagagtttccgcgcgaccactcccagtttggtttcgtaggcgcggggccgctctccgagggcgccctcagagcccgcgattgatataaatatgtaatctgtattgatgggccaggagacgcaccccgacaccttggcccgaaggccgggagctgtgggggctgccccaacgtggctggtggggggcctggccattgggctcgccccgcccctacccggacgtgagccccataccggggtcccttagaagggcccttgggccccgcgcagttaacaagtggggtgtttatggtgcgcgcccagtctgccttgggtgctcaccatccctgtcgcagaagctgccactagtccccggtgtactctaaccactgaagcggccgtgtcggggactcacgcgc

SEQ ID NO: 127466 - DNA, 524 bp, Homo sapiens; identical to SEQ ID NO: 97315
  misc_feature 1..524: note = chr7:27219320-27219844
  misc_feature 1..524: note = Hyper
  source 1..524: mol_type = genomic DNA

SEQ ID NO: 127467 - DNA, 192 bp, Homo sapiens
  misc_feature 1..192: note = chr7:27223114-27223306
  misc_feature 1..192: note = Hyper
  source 1..192: mol_type = genomic DNA
ccttaacatctggggcggctgccgggtctttgtcagcctgagtcctggccaccagcttctgcctccccggccagccttccggctccgccgaggtggggaggtggcggcggaagccccctaccctaggccttcgctgagcaccacggccacacggccatcctgcacacggcagagcagcggctctatcttagg

SEQ ID NO: 127468 - DNA, 1583 bp, Homo sapiens
  misc_feature 1..1583: note = chr7:27223574-27225157
  misc_feature 1..1583: note = Hyper
  source 1..1583: mol_type = genomic DNA
actttatctgttaaacgcgctcctagcgccgtcgttaaacagcgacgcctttgaatcccggccgggactggagtcccggcgcaacacatggcttttataaaaatctccggattacctcgctatcaaaagctcccgaagcccttgcagggggaatttacaggcgcccacctccggctccccagcctggagctggccccgagcggggtcgagctgctgggcttgggagctgagaagggaaaaaagggaaaaggggagttgtttttttttgcaggcatgccttggccggtgggtatttcacggccaatttcagcactcgccacgtgatcccgccttttataacaaagttttgttgggggaaacctaaaggcccttcataaaccttatatgcttataaaacagcatataaaaatttaacagcggtgctgcgctagatttccaactcccctttcataaagcgcagggcgctgcctttatacgtactggagccgccggccttgtcctcagtgtggccggaagacgactcggggctgctgctgctctcggggcgccgccgccgctctttctcctctgctgccgccgccgtctcccggcagccgccgccgccgccgctgtccgaacttgaagttgccggcgcgcccgttgcagccgccgccgccgccgcggaggtcgccgtggccgccgggggccccttctcggcgctcttgtccccggggtagtcggaggaggcgaggttttccggggtgccgtaggctgtctcgaaaaactggtcgaaagcctgtggcaggacgccgttcctgcccacggtgctatagaaattggacgagactgcgggggtggggtggtggtagacgttggccgagctcttggccagcacgtcgccaggcacgccggccgcgctgggcgcctgcaggcagtctctgtgcacgagctcctccgcggagtagcagtgggccagattgccgcgggggtgccatttagtggcgggctcaatggcgtactctctgaaggtcacttcgcgcacgggttggacctggggcaggttggaggagtaggagtatgtcattgggcgcgaagacggggtctggggcagaaaagaagggaggctggagaaatctggacccgagacgtagtaagtacaacttggcaaatacatgttagaggagcagggaccacgctcatcaaaatccattattgggctaccttgggctctccgcagtagccgagcttaacatgattctccactgcagctgcctctttgaagcggatccgtgaagtagaaatttggagacgtaagctgacgtggaaatctatccccatccttagcagggaggtgctggtcatgtgacccgatgttgaaattgacaagctgctagctagtccgggccttttccccccccctttccttttttttttttcctcctctcccctccctcccggcttcctttctttgtagccacctcaggggaagcaacagatcgtcactcggtgttctcaccgaaagcacgtaatcgccggtgtaactcatgttggctggggggcctcccggcgcgcgcggagaggctggggtgcgcccccatgcagca

SEQ ID NO: 127469 - DNA, 268 bp, Homo sapiens; identical to SEQ ID NO: 97319
  misc_feature 1..268: note = chr7:27227776-27228044
  misc_feature 1..268: note = Hyper
  source 1..268: mol_type = genomic DNA

SEQ ID NO: 127470 - DNA, 52 bp, Homo sapiens; identical to SEQ ID NO: 97320
  misc_feature 1..52: note = chr7:27228676-27228728
  misc_feature 1..52: note = Hyper
  source 1..52: mol_type = genomic DNA

SEQ ID NO: 127471 - DNA, 887 bp, Homo sapiens; identical to SEQ ID NO: 97321
  misc_feature 1..887: note = chr7:27232211-27233098
  misc_feature 1..887: note = Hyper
  source 1..887: mol_type = genomic DNA

SEQ ID NO: 127472 - DNA, 30 bp, Homo sapiens; identical to SEQ ID NO: 31155
  misc_feature 1..30: note = chr7:27237273-27237303
  misc_feature 1..30: note = Hyper
  source 1..30: mol_type = genomic DNA

SEQ ID NO: 127473 - DNA, 30 bp, Homo sapiens; identical to SEQ ID NO: 97323
  misc_feature 1..30: note = chr7:27237530-27237560
  misc_feature 1..30: note = Hyper
  source 1..30: mol_type = genomic DNA

SEQ ID NO: 127474 - DNA, 179 bp, Homo sapiens; identical to SEQ ID NO: 97324
  misc_feature 1..179: note = chr7:27237991-27238170
  misc_feature 1..179: note = Hyper
  source 1..179: mol_type = genomic DNA

SEQ ID NO: 127475 - DNA, 410 bp, Homo sapiens; identical to SEQ ID NO: 97325
  misc_feature 1..410: note = chr7:27238507-27238917
  misc_feature 1..410: note = Hyper
  source 1..410: mol_type = genomic DNA

SEQ ID NO: 127476 - DNA, 1183 bp, Homo sapiens
  misc_feature 1..1183: note = chr7:27239141-27240324
  misc_feature 1..1183: note = Hyper
  source 1..1183: mol_type = genomic DNA
gcccatgcgggcgcacgggtagtagccgctgccgaagtagccatagggcagcgccgcgggccccgacgagctctgcgccgctgccgagcaggggctgcattgcttggcggcctctgcgcccgccgggcccgccgggccgggacctcccgaggacgacgcggcggcggcggcggcggctgcagcggcagccgcggcagcagcggcggcagccgacgggggcgcctccccgggggcgctgctgtaggcggacgcggctcctggcgccaagggcgccgggtgcgccatcaggttgcggcactggttggccgcggccgccgccgcagccgcggccgccgccgccaccgagaagttgccccctgccgccgcagccgccgggtgggggaagcccccgcccccggccccggcagccgccgccgctgcagccgctgctgcagccgccgccgccccttccatgttcttgttgagctcgtcggccaccaggccgccgccgttgtcgtagagaaacatgacggtgggctcgatccagcgggggtggaggagcacggaggctgtcatagcccgagccgcatggagaagaccccagtggcgctgttttaaaaagcccccaagaagtgaagagcgcgcggcgcggggccggggcccgagcgaggggggcggatcgcgccccgcggggtcgcgccaggcggccgcccattggcccggcccccccgctccgcccacggcgtatgcaaagcgggcggctccgactccagctctgcacggtgcacccgtcgtccccgccgcggcccgcgccgtccccagcgccagccgcgcggccgcgcaccattcacccgggggagaggcggaggaacgtgcgggtggggcagggaaggaaggcggccccatctccgccccccttcccttcctttatcccagtggggcccagacccgcgcaaccaggcggggaggggaggtgggcgcgcgattgggttgcgatctggagcagtggggacaggtcaggtaattctgccggcggtcagggatgggagagtggggaggacgggaccagcctagctcagaatgggtgtttcttggagcctctgggactgttttctttccaggaaccggcgcgtatttctgcagtgagaccacaggacggacatcggcgccttcggcttcgatggagttgcgattttgctctttc

SEQ ID NO: 127477 - DNA, 181 bp, Homo sapiens; identical to SEQ ID NO: 31161
  misc_feature 1..181: note = chr7:27240992-27241173
  misc_feature 1..181: note = Hyper
  source 1..181: mol_type = genomic DNA

SEQ ID NO: 127478 - DNA, 32 bp, Homo sapiens; identical to SEQ ID NO: 97329
  misc_feature 1..32: note = chr7:27242143-27242175
  misc_feature 1..32: note = Hyper
  source 1..32: mol_type = genomic DNA

SEQ ID NO: 127479 - DNA, 771 bp, Homo sapiens
  misc_feature 1..771: note = chr7:27244539-27245310
  misc_feature 1..771: note = Hyper
  source 1..771: mol_type = genomic DNA
actcctcagagctggcgcaaactccgtcctccaaaactcggctctgggaggcctaagtgactccgaagccggcggcagccgcggcagcggccgtggtggtggaagagctcttttccccgacagtgccactgatcgctcttcactggagctggaaacagccttcgcggaaaggaccggagcatgcgttagaagcagagggagcttggtgaagggctcggctggaaggaggaaacgccttctcgcagtgcgcggccagcccgcgggggacaccggcttgctggactgcaggggcccgtgccacccaggaagtgacctgcgggtcactcagccggggcgctgggcgagcgcgggacggcccggagaattccgtgcggctgcgacgggaaaaggacgaggggtctctgtacccgacgctgccactggcccaaaggaattttacccgcgagcgcccaccccaccctagcttgatgcttacgcccgcaacaaaacaggaaaccaggactgggcagtgcattctttaagtcaacaaatacactgaagacttcgagcgtttgaaggaaggagggggtttgcacgtaagcctggccccgccgggctcggctttctcgctgagaaagcggcgcaggcagccaggcggcctgggcccgcgggggtccatctcgccctagactcctaagaactcccacggccctgttcccagctgcgaattcttaatgcacaacgcgacggagggaaggaaattcaccagcgcagcgacgaggaaggggaact

SEQ ID NO: 127480 - DNA, 114 bp, Homo sapiens; identical to SEQ ID NO: 97332
  misc_feature 1..114: note = chr7:27245526-27245640
  misc_feature 1..114: note = Hyper
  source 1..114: mol_type = genomic DNA

SEQ ID NO: 127481 - DNA, 165 bp, Homo sapiens; identical to SEQ ID NO: 31165
  misc_feature 1..165: note = chr7:27250066-27250231
  misc_feature 1..165: note = Hyper
  source 1..165: mol_type = genomic DNA

SEQ ID NO: 127482 - DNA, 822 bp, Homo sapiens
  misc_feature 1..822: note = chr7:27252370-27253192
  misc_feature 1..822: note = Hyper
  source 1..822: mol_type = genomic DNA
acctcttcaggcgaccgcacccttccgctgaagtcccccacttctgcccctccgaggtggggtgggggtgttctgaaataacggtggctgcagttagatggctgaggacatagaaagcggttgttatttattccaggcaccatcacaaaaggcttccaaaaatatcgagccgagatattttattgtccagcctgtctgcagcctgtaattatgcgttcaagatgtttaatgtgtgcaaatgcattagccgctttcgctggtgaaaaccctagctgggggcggggtagaggcaagtctggagataattatgtcgtacagtcgcaaacattattccgttcttactgtaaacggccccggccacctttacgagaaaccaggaaacttctgagagttactagcagcgtttacgcgggcaaactgagttctttttctttctctcccggattgttcgaagtatctatcgggcggcttcgatgccaggttcagaggcgcgccagggagagggcgccccgcagaggagcgcagcggagaggcctacgcaggtccccggtgcccgcggccctcggaggccgggccctgcgtcttggccaggcactgggtggcagctgaggctggtggcccggagccctcgcggccgcgggcaggccccttcttgggcagggtcgggcactcccgctgtccagggctcttcggcaccctccttccaatcaggtcgctctcccctgctccccagactcaactcctccgaagctgctccaggttgaaatgtgaccgctaggccgactccctgggcccgcgagcagttctcgaaaggtgcggact

SEQ ID NO: 127483 - DNA, 1013 bp, Homo sapiens; identical to SEQ ID NO: 97336
  misc_feature 1..1013: note = chr7:27264571-27265584
  misc_feature 1..1013: note = Hyper
  source 1..1013: mol_type = genomic DNA

SEQ ID NO: 127484 - DNA, 480 bp, Homo sapiens
  misc_feature 1..480: note = chr7:27274962-27275442
  misc_feature 1..480: note = Hyper
  source 1..480: mol_type = genomic DNA
acctatcacccatcccgcttagggtccagctcagagagcgggcgcatagggcctggtggaacaggctgccctctggggatgggggattggggccgctgctccgggcagagccgcgggatccgagccagcaaggatgctgggactcgccgcgacttccgcctctggcgatcggcagtggggggcgcaccaagacagcagttcgggagctgcgctttgtcaccgaggcggcgaggggcggagggcgcagaaaggggccgcggagaaaggacaaggcggccgaccagctcccaggatggaaagggaccctcaaggggctccaggcagcacctggggcaaggggagggactgatactcccggccggagcccaacctgtggcgcgtgcttcagtcctgagccagcggctccctggcttctgggctggcatccgtcctaccctcctcccgctgcaacacgcccctgatagccgctcccccaccctc

SEQ ID NO: 127485 - DNA, 594 bp, Homo sapiens
  misc_feature 1..594: note = chr7:27279065-27279659
  misc_feature 1..594: note = Hyper
  source 1..594: mol_type = genomic DNA
gcgggccatctcccccgagccgggcgggcagactgcggaggcaggccccacacgcgccgcttttccgagcccggttttcttcaggagcgaagctgttccagctgacccgcgcgtctgggggcctatgcccggcttccgattccatttaaaacgacccgcgcatcttatctccgtcgcctccccggggttcccacccacccccctccggcccgggccaggccagcccagccccggcggaagccaagctgggagcttttgaagtccggagaatttcaatccgagaggagccggctggaccggagcccgtcgccccagcgggggaagggacggggggcctgccgtgtggcaggtgggggatgggtgtcccccgccgcgagaaatgagaagccgccgggcctggagcggcctccacctcagctgctatcaccccctctccgctgtcatgggattgcccaggcttaatggggttgtgcagggcttcacttgctctcggaatttaccttccttctcgagccgtgccgcgaataaccttcacgacacagtgataacgatgttattaaatactccccccacattcaccgcccaaaaaaccaa

SEQ ID NO: 127486 - DNA, 1627 bp, Homo sapiens
  misc_feature 1..1627: note = chr7:27281948-27283575
  misc_feature 1..1627: note = Hyper
  source 1..1627: mol_type = genomic DNA
ttgaggcttgtaagccgggcttcacacttctaaaatgcagttatggattctttcatcggtgttagatcaaggcaccaagttaagaaaacaaaagtcaaaacaacaataaaagaaaaaatcaaaagcttatttaattaccgagtcccgctgcccctgcggaactcgccgcgcgcgttaagctctcttttctttctgcggaattccatttgcatcccctctgcctgggtgtctccctctctcagtgtgtgtgtctctctgtctgttttcacactctcctccccaatcgagcgaggcccacacctggcgcatcactgccgagccattagctgcgggtttcctttcatcttcgctgtggcagacgtttctatttatccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtgaccctagctcccaccgccaccgccgcggtcgcggtccagaccgcgctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaaggtagccaccgtgcccctccgctccccgggcctcccactgcgcccacccttcacttcggcgcaggccaggaggaagacactcccttcccctagggcaggatggctggggggacccacctgagcaactctctctgctatctgcgttctggcgggggtctcctactgtgttctggcattggcgggactgagggtgacagcagtgccttgagtgcggggtgctgagggggcggatgcaagtcctggacttgggggattcgaagctcaccccaagcacccagtgtttcaactgctcggggaatgcttcaattgctcggggaagacactttccccaggcgagggcaagatcaaacgccgatccgggcagtttgtggctggcagggtgtaagaggcatggaggcgcggaagccaggagtccataaaggaccgtaaaattgcggcccacttgggcagcccgggtgctgcagccctccgaccagtttgcacgtcggtcagaggtccaa

SEQ ID NO: 127487 - DNA, 219 bp, Homo sapiens
  misc_feature 1..219: note = chr7:27284655-27284874
  misc_feature 1..219: note = Hyper
  source 1..219: mol_type = genomic DNA
tcgctgtgcagggtccggctccgaggcgctggtcggcagtccgaacggagggagcgagacccccaagagcaacggcggcagtggtgggggcggctcgcaaggcaccctggcgtgcagcgccagtgaccagatgcgtcgttaccgcaccgccttcacccgagagcagattgcgcggctggagaaggaattctaccgggagaactacgtatccaggccgcg

SEQ ID NO: 127488 - DNA, 707 bp, Homo sapiens
  misc_feature 1..707: note = chr7:27285445-27286152
  misc_feature 1..707: note = Hyper
  source 1..707: mol_type = genomic DNA
ctggcctctgagcatcgggccaagtccagctactgaacctgctccgctcctctccccaggtgtggttccagaaccggcgcatgaaggacaagcggcagcgcctggccatgacgtggccgcacccggcggaccccgccttctacacttacatgatgagccatgcggcggccgcgggcggcctgccctaccccttcccatcgcacctgcccctgccctactactcgccggtgggcctgggcgccgcatccgccgcctccgccgccgcctcgcccttcagcggctcgctgcgcccgctcgacacgttccgcgtgctgtcgcagccctacccgcggcccgaactgctgtgcgccttccgccacccgccgctctaccccgggcccgcgcacggactgggcgcctctgccggcggcccctgctcctgcctcgcctgtcacagcggcccggccaacgggctggcgccccgggctgccgccgcctcggacttcacctgtgcctccacctcccgctcggactccttcctcaccttcgcgccctcggtgctcagcaaggcctcctccgtcgcgctggaccagagggaggaggtgcccctcactagataaggggccgccggctggctgccggctccatgacgcccgtggggtcaccccccggccccgggactcagccagcctcgctcctcgctcctcgctcctcgcccctaggacgcc

SEQ ID NO: 127489 - DNA, 620 bp, Homo sapiens
  misc_feature 1..620: note = chr7:27288946-27289566
  misc_feature 1..620: note = Hyper
  source 1..620: mol_type = genomic DNA
acagctattagtggccgatgtagctatgagctccgggctcccacttcctcttctcttaccctgttctggggcacagattctgaggtaacccccagtgaagcctgacacctcactcccgactcacgctttcccagggctcttcaatcccggccagccggcagggcctgggagcgcggtccagcgcccagcccagattcgcccagttgggcaaggctggccaccccgcagcccgagtgtgcaccggcccccggcaattgctggcttgttagcgtgtgattgattgccttattaaagcgtgttcttgtaagtgtgaccaaactgattgcattgcatatgtttgggataatgctcattttaaacaacaggataaagaggatgagctccgcagagccttgaagacaaaatgattctggctagcagctccctaactatggcattaaattgctcagttacatagcaaatcgctacttggtttctgcatccttgtccgtattttttttttttctgtcctacagtttgatcctgtctcccaatgtggcatgccccacgaacggtttctttagtgattatgttgactccaccttcctagtttcaaaccctgcacccgcactctccagaca

SEQ ID NO: 127490 - DNA, 93 bp, Homo sapiens; identical to SEQ ID NO: 97346
  misc_feature 1..93: note = chr7:27289789-27289882
  misc_feature 1..93: note = Hyper
  source 1..93: mol_type = genomic DNA

SEQ ID NO: 127491 - DNA, 1232 bp, Homo sapiens
  misc_feature 1..1232: note = chr7:27290946-27292178
  misc_feature 1..1232: note = Hyper
  source 1..1232: mol_type = genomic DNA
aaagtcatatccttgcgtcttcatcgagattatttatagcgcagtgagcgctgctgaaaggtatacgctgttaacagggacaattacttaaagggaagcgtttgtaaaatggaaaacaaatgccggggttggtaacaaatgggatcaaaagcagccattccaatctggctccccgagggaaaggagcgggcgtggccctgtaggattaggggcgcttctgacctccccaagacccaggtgaggccgagggtccccggcgcgccagcctgcgccgtggctgtggctgcggtggcgactcgggccgggcctcgctctcgccggcttcaggttcccgcctccctcgcgcaggcagcgggcgcgtgtggcccgggctgggcaagccgaggaacagcgagcccccggacgctgactgcaggacgtcccagtttgtgcccgggtctccgtccctccccgtacggggctcgtacccccgggcctgggtctgacccacagggcgctgaggcctttgtagctgaagtcggaaggcctcgttgcgagcgcggcacaggttgctggtagcttctggactctggaggcttggccttccttctaagccgatggcggggaaagaacctcgtttccacagcttccccgacccccgccgcttgccatttggggacgggaagcgcgcccgggtcgcttcacgtccctctgggccggagccctttccatggctggctcctctgggggcccttgggcctgtgagcagcgtctacttccctcagagaagaatcctttccttcccccatcgaagtgtccctttctgtatcctgaaataacccctcctgggtgaggccagttcccctctgtcgccctcctcccgcaggcgtccgggagcctcgtgaggaccccgtgcagttgagtccaggcgacaggtgcctccccaggtgtctacttgccctccctcaacctgtttagggaaagaccagaacgatgtgcgcggggaggtggttttgtttctcccgaaactggcgctcttgggtaaaaccgcgtgccgcgtctacgcgggctctgttagtgtgcgtgtcccagaagagtgggccttctaggcggcactctttggagaagtaagtgaggtgaactcagaacagagaagcgggaacgatcgtttgatgtgccgagccggaaaaagagaggagagggagaggctcccagcgagcgcggagacagaggagcccacgcggcacagcacg

SEQ ID NO: 127492 - DNA, 56 bp, Homo sapiens; identical to SEQ ID NO: 97351
  misc_feature 1..56: note = chr7:27531197-27531253
  misc_feature 1..56: note = Hypo
  source 1..56: mol_type = genomic DNA

SEQ ID NO: 127493 - DNA, 203 bp, Homo sapiens; identical to SEQ ID NO: 97352
  misc_feature 1..203: note = chr7:27555618-27555821
  misc_feature 1..203: note = Hypo
  source 1..203: mol_type = genomic DNA

SEQ ID NO: 127494 - DNA, 30 bp, Homo sapiens; identical to SEQ ID NO: 97353
  misc_feature 1..30: note = chr7:27591774-27591804
  misc_feature 1..30: note = Hypo
  source 1..30: mol_type = genomic DNA

SEQ ID NO: 127495 - DNA, 47 bp, Homo sapiens; identical to SEQ ID NO: 97354
  misc_feature 1..47: note = chr7:27686768-27686815
  misc_feature 1..47: note = Hypo
  source 1..47: mol_type = genomic DNA

SEQ ID NO: 127496 - DNA, 32 bp, Homo sapiens; identical to SEQ ID NO: 41235
  misc_feature 1..32: note = chr7:27903816-27903848
  misc_feature 1..32: note = Hypo
  source 1..32: mol_type = genomic DNA

SEQ ID NO: 127497 - DNA, 67 bp, Homo sapiens; identical to SEQ ID NO: 97357
  misc_feature 1..67: note = chr7:27905659-27905726
  misc_feature 1..67: note = Hypo
  source 1..67: mol_type = genomic DNA

SEQ ID NO: 127498 - DNA, 242 bp, Homo sapiens; identical to SEQ ID NO: 97358
  misc_feature 1..242: note = chr7:27907826-27908068
  misc_feature 1..242: note = Hypo
  source 1..242: mol_type = genomic DNA

SEQ ID NO: 127499 - DNA, 99 bp, Homo sapiens; identical to SEQ ID NO: 97359
  misc_feature 1..99: note = chr7:27916674-27916773
  misc_feature 1..99: note = Hypo
  source 1..99: mol_type = genomic DNA

SEQ ID NO: 127500 - DNA, 30 bp, Homo sapiens; identical to SEQ ID NO: 97360
  misc_feature 1..30: note = chr7:27980078-27980108
  misc_feature 1..30: note = Hypo
  source 1..30: mol_type = genomic DNA

SEQ ID NO: 127501 - DNA, 24 bp, Homo sapiens
  misc_feature 1..24: note = chr7:28049405-28049429
  misc_feature 1..24: note = Hypo
  source 1..24: mol_type = genomic DNA
tcaccattgcgttttttaaaaatg

SEQ ID NO: 127502 - DNA, 116 bp, Homo sapiens; identical to SEQ ID NO: 97363
  misc_feature 1..116: note = chr7:28050616-28050732
  misc_feature 1..116: note = Hypo
  source 1..116: mol_type = genomic DNA

SEQ ID NO: 127503 - DNA, 30 bp, Homo sapiens; identical to SEQ ID NO: 41239
  misc_feature 1..30: note = chr7:28055637-28055667
  misc_feature 1..30: note = Hypo
  source 1..30: mol_type = genomic DNA

SEQ ID NO: 127504 - DNA, 30 bp, Homo sapiens; identical to SEQ ID NO: 97365
  misc_feature 1..30: note = chr7:28241732-28241762
  misc_feature 1..30: note = Hypo
  source 1..30: mol_type = genomic DNA

SEQ ID NO: 127505 - DNA, 128 bp, Homo sapiens; identical to SEQ ID NO: 97366
  misc_feature 1..128: note = chr7:28258505-28258633
  misc_feature 1..128: note = Hypo
  source 1..128: mol_type = genomic DNA

SEQ ID NO: 127506 - DNA, 24 bp, Homo sapiens
  misc_feature 1..24: note = chr7:28310468-28310492
  misc_feature 1..24: note = Hypo
  source 1..24: mol_type = genomic DNA
acagaatgagtccagcgggcctga

SEQ ID NO: 127507 - DNA, 183 bp, Homo sapiens; identical to SEQ ID NO: 97368
  misc_feature 1..183: note = chr7:28351972-28352155
  misc_feature 1..183: note = Hypo
  source 1..183: mol_type = genomic DNA

SEQ ID NO: 127508 - DNA, 25 bp, Homo sapiens
  misc_feature 1..25: note = chr7:28366473-28366498
  misc_feature 1..25: note = Hypo
  source 1..25: mol_type = genomic DNA
tatttaggctgggtgcggtggctca

SEQ ID NO: 127509 - DNA, 1539 bp, Homo sapiens
  misc_feature 1..1539: note = chr7:28448701-28450240
  misc_feature 1..1539: note = Hyper
  source 1..1539: mol_type = genomic DNA
ctaatgtcagggagccgtgtcacacggcgctgggctctgcaagctgttgcttgcgcagtcgcccccgccgctgccgctcccgggcgggtgcaccagggtccgcgcgggcggggcggggtcggggcgggaccggggcggggcctgccccctcgacgcgccggccccgcccctcgctccgtccctccccagcggaccgcaatgatttagaagttcaggaatcccacgtgacgtcaccgggggggtgatgtaatgcactctaaatagaatgtattgtaatctttgctcagtccaacgtggtcccttcacccgggctccgctcttgccttctccacacttgtttggtaagttcctaaaaatacggctcggccacttctggggcttttgcatttagccacttttgttgcacttgccgcaggagccatctcgggagtgtacttgtttgcaggggttggttctcggcagcagccgcgaggttacttggtccagtgggcaggtcacagggcaaggagtagggaagatgcgatgcatttttttctggagggtgatctgtgtttgtaaacattttggcggaccagagggaagtccggccccgagtgctggtagactgtggaattcggctgtgtcctgaggccaccctagagaccccgcgccgcgtgagtgccggagcgctcggtggccgccgcgccgcgcgcctggagggatgctaacgtggagccggcgccgagtccgcccggcgtgcgtgcgtgtgtgggagcgcgcgagtcccctgacgcggggaccagttatgaatcgggggtgtgtgtttgcctccagagacctggcaaggtgcggagccctccagaagtgcggtcaagcggcagcggagacggcgagccaggaacctccccccgcgtccccagcttcccagcgtggcggcggaacccccggagaaagtttgcaaacttccagcgggcgcggcgaggacgccgggtcacctagggggcgggtgggcgcgcgcgcagggggctcgctctccccggtgcggagctgcagctgccacctctcccgccgggctgccggctgcagcgggtgggcgcgcgcccggggaggggaggtcgccctcggagggcgcttggctttcgctccaggcgctccgggctggagagcggcgaggctccgtccgctccagtccactcctccggccgcctcctgcctccgctgctttcttgctggcatcgttacctcttcccggccgctgccccaaatgacagctccggctcgagctttggcggcgcccaggcaattcccaagacctggcggcggagtctccccctgcggcagattctcggcagaatcacttgaacttttcacgaagttcttagaggggcaagatgcgaaggaaggaaccaaggagatgttttctctcagcagctgcatcccgcttcttctttgccatagatttatttttaaggggcgtctggtagataaagccctagaccttgtccacactctcacccccatccccaactttccctggaccggtgccgcccccacttgatg

SEQ ID NO: 127510 - DNA, 99 bp, Homo sapiens; identical to SEQ ID NO: 97373
  misc_feature 1..99: note = chr7:28450611-28450710
  misc_feature 1..99: note = Hyper
  source 1..99: mol_type = genomic DNA

SEQ ID NO: 127511 - DNA, 30 bp, Homo sapiens; identical to SEQ ID NO: 97374
  misc_feature 1..30: note = chr7:28535177-28535207
  misc_feature 1..30: note = Hypo
  source 1..30: mol_type = genomic DNA

SEQ ID NO: 127512 - DNA, 21 bp, Homo sapiens
  misc_feature 1..21: note = chr7:28571358-28571379
  misc_feature 1..21: note = Hypo
  source 1..21: mol_type = genomic DNA
ctgaggctagccgggcgtggg

SEQ ID NO: 127513 - DNA, 30 bp, Homo sapiens; identical to SEQ ID NO: 97376
  misc_feature 1..30: note = chr7:28572177-28572207
  misc_feature 1..30: note = Hypo
  source 1..30: mol_type = genomic DNA

SEQ ID NO: 127514 - DNA, 30 bp, Homo sapiens; identical to SEQ ID NO: 97379
  misc_feature 1..30: note = chr7:28887552-28887582
  misc_feature 1..30: note = Hypo
  source 1..30: mol_type = genomic DNA

SEQ ID NO: 127515 - DNA, 221 bp, Homo sapiens; identical to SEQ ID NO: 31183
  misc_feature 1..221: note = chr7:28893380-28893601
  misc_feature 1..221: note = Hyper
  source 1..221: mol_type = genomic DNA

SEQ ID NO: 127516 - DNA, 197 bp, Homo sapiens; identical to SEQ ID NO: 97381
  misc_feature 1..197: note = chr7:28907350-28907547
  misc_feature 1..197: note = Hypo
  source 1..197: mol_type = genomic DNA

SEQ ID NO: 127517 - DNA, 32 bp, Homo sapiens; identical to SEQ ID NO: 97382
  misc_feature 1..32: note = chr7:28988955-28988987
  misc_feature 1..32: note = Hypo
  source 1..32: mol_type = genomic DNA

SEQ ID NO: 127518 - DNA, 151 bp, Homo sapiens; identical to SEQ ID NO: 97383
  misc_feature 1..151: note = chr7:28989227-28989378
  misc_feature 1..151: note = Hypo
  source 1..151: mol_type = genomic DNA

SEQ ID NO: 127519 - DNA, 425 bp, Homo sapiens; identical to SEQ ID NO: 97384
  misc_feature 1..425: note = chr7:28995567-28995992
  misc_feature 1..425: note = Hyper
  source 1..425: mol_type = genomic DNA

SEQ ID NO: 127520 - DNA, 1885 bp, Homo sapiens
  misc_feature 1..1885: note = chr7:28996324-28998209
  misc_feature 1..1885: note = Hyper
  source 1..1885: mol_type = genomic DNA
gagacctgcaggtggcgtcatctcctcccctgcggccgtgggtaggggctgccgcctgcggtcagcggtcagggaagctgagggcgagggatccgcgcaggatccattttgcagctgctggtcatccaggtaatccaggtatttgcctcgcagggccggggggtggcgacactgcacgaagacagtgaggagccggccctgcgagtgccagtcgcccatccagcgcttcaggcctcgcagccggcagtcgcaggtccagccgttgccgtctagatccagccgataaagggctgggctggcggcgaagatgtccccggatagggcgctgagcgcgttgttgcgcaggctgagctcgcgcagccggcccaggtggccgaaggtggccgggtgcagggcggacagctcattgccgctcaggtccagcgcctccaggctgtgcagaggctccagcagcgcagttggcagctggctcagccgattaccctccaggcgcagctcgcgcagggcctccaagccccaaaaggcctcaggcgcgaggtgcgtgagctggttgcccctgagcgagagcaggccgagacgtggcaggtgctggaagatgcgcggcccgaggtgctgcaggttgttggccgagaggatgagggaggagagggagcgcagcggtgcgaaggtggccgcgtggcgcagggagggctgtagctcgttggcagagaggttgaggaagcgcagcttgcctagctgggcgaaggcgttcttgcccagaaagcggatccggttggactccagatgtaggtagagcaggttgcccaagggagcgaagaccgcgtccggcagcgcccccagggcgttcccgtccagccgcagcttgactagactctccaggccctcgaaggagccgcggcttaggcggctgatctcgttcccgttggcgtagaggatgcgcagcttgcgcagcggggccagcgtgcccggggcgagcgcctgcaagaggttgttccccaggtacagctcttccagccgcgagagcttctcgaaggtcttggggtgcagagagcggatctggttgtactgcaggtccagccgtctgagctgccccagacggtggaagtcgaaggccgtgatgttggttatgaagttgccgccgaggctgtaggtgagcacgtcgtgggggctcggccagcgagctggtcttgggcactacgcggagccccctgttggtgcacaggagatgctggggatgctggcagtcgcagcgctccgggcacacgggctcggcagcggcgggagcgcgaggcagccgcacaccacgagcaggaggcgcaaggcgcgggcagcctccatcgcctcccgccctgcgtgcagcggccggatcgtcctcttggcccgccggctctgtgtctcctctgcattccccttagcctggccagagtcgctaaatggcctctttcggacttcgcagcgccgtccagcccctcctccgtcctttgtccggaggccggcccgggtctctgcaggcgggcttcgcccggccaagtcaggcggcgcggggcgctctgcagaccccgggtactacttgttgcatttctgtataaaactgtttctccgggtgcgcgtcggcgggcgggaggagggagcaagacccggcgctttttgtttgcagctgagtccggagagctggattccctggcgcggattctcccagccgagtggattccccagctgcaggcgggagccgttccaagagcttcgcggggcgcggcttggcagcagagccccggctgctcggcccccgcagacggcaccttctcgctcgcggtcccggacggggagggcggctccagtgcaatagctcggggagcacgcgggctgcgtccggaagggacccaag

SEQ ID NO: 127521 - DNA, 382 bp, Homo sapiens; identical to SEQ ID NO: 31189
  misc_feature 1..382: note = chr7:29185815-29186197
  misc_feature 1..382: note = Hyper
  source 1..382: mol_type = genomic DNA

SEQ ID NO: 127522 - DNA, 382 bp, Homo sapiens; identical to SEQ ID NO: 97392
  misc_feature 1..382: note = chr7:29234504-29234886
  misc_feature 1..382: note = Hyper
  source 1..382: mol_type = genomic DNA

SEQ ID NO: 127523 - DNA, 105 bp, Homo sapiens; identical to SEQ ID NO: 97396
  misc_feature 1..105: note = chr7:29482437-29482542
  misc_feature 1..105: note = Hypo
  source 1..105: mol_type = genomic DNA

SEQ ID NO: 127524 - DNA, 1463 bp, Homo sapiens; identical to SEQ ID NO: 97401
  misc_feature 1..1463: note = chr7:29603263-29604726
  misc_feature 1..1463: note = Hyper
  source 1..1463: mol_type = genomic DNA

SEQ ID NO: 127525 - DNA, 97 bp, Homo sapiens; identical to SEQ ID NO: 97406
  misc_feature 1..97: note = chr7:29679947-29680044
  misc_feature 1..97: note = Hypo
  source 1..97: mol_type = genomic DNA

SEQ ID NO: 127526 - DNA, 124 bp, Homo sapiens; identical to SEQ ID NO: 97410
  misc_feature 1..124: note = chr7:29845873-29845997
  misc_feature 1..124: note = Hyper
  source 1..124: mol_type = genomic DNA

SEQ ID NO: 127527 - DNA, 547 bp, Homo sapiens; identical to SEQ ID NO: 97411
  misc_feature 1..547: note = chr7:29846202-29846749
  misc_feature 1..547: note = Hyper
  source 1..547: mol_type = genomic DNA

SEQ ID NO: 127528 - DNA, 38 bp, Homo sapiens; identical to SEQ ID NO: 41244
  misc_feature 1..38: note = chr7:29876677-29876715
  misc_feature 1..38: note = Hypo
  source 1..38: mol_type = genomic DNA

SEQ ID NO: 127529 - DNA, 218 bp, Homo sapiens; identical to SEQ ID NO: 97413
  misc_feature 1..218: note = chr7:29883063-29883281
  misc_feature 1..218: note = Hypo
  source 1..218: mol_type = genomic DNA

SEQ ID NO: 127530 - DNA, 30 bp, Homo sapiens; identical to SEQ ID NO: 97414
  misc_feature 1..30: note = chr7:29884235-29884265
  misc_feature 1..30: note = Hypo
  source 1..30: mol_type = genomic DNA

SEQ ID NO: 127531 - DNA, 30 bp, Homo sapiens; identical to SEQ ID NO: 97415
  misc_feature 1..30: note = chr7:29966074-29966104
  misc_feature 1..30: note = Hypo
  source 1..30: mol_type = genomic DNA

SEQ ID NO: 127532 - DNA, 30 bp, Homo sapiens; identical to SEQ ID NO: 97416
  misc_feature 1..30: note = chr7:29977605-29977635
  misc_feature 1..30: note = Hypo
  source 1..30: mol_type = genomic DNA

SEQ ID NO: 127533 - DNA, 369 bp, Homo sapiens; identical to SEQ ID NO: 97417
  misc_feature 1..369: note = chr7:30028510-30028879
  misc_feature 1..369: note = Hyper
  source 1..369: mol_type = genomic DNA

SEQ ID NO: 127534 - DNA, 54 bp, Homo sapiens; identical to SEQ ID NO: 97418
  misc_feature 1..54: note = chr7:30029248-30029302
  misc_feature 1..54: note = Hyper
  source 1..54: mol_type = genomic DNA

SEQ ID NO: 127535 - DNA, 38 bp, Homo sapiens; identical to SEQ ID NO: 97419
  misc_feature 1..38: note = chr7:30180528-30180566
  misc_feature 1..38: note = Hypo
  source 1..38: mol_type = genomic DNA

SEQ ID NO: 127536 - DNA, 153 bp, Homo sapiens; identical to SEQ ID NO: 97420
  misc_feature 1..153: note = chr7:30206381-30206534
  misc_feature 1..153: note = Hypo
  source 1..153: mol_type = genomic DNA

SEQ ID NO: 127537 - DNA, 38 bp, Homo sapiens; identical to SEQ ID NO: 97423
  misc_feature 1..38: note = chr7:30340811-30340849
  misc_feature 1..38: note = Hypo
  source 1..38: mol_type = genomic DNA

SEQ ID NO: 127538 - DNA, 41 bp, Homo sapiens; identical to SEQ ID NO: 97426
  misc_feature 1..41: note = chr7:30565248-30565289
  misc_feature 1..41: note = Hypo
  source 1..41: mol_type = genomic DNA

SEQ ID NO: 127539 - DNA, 45 bp, Homo sapiens; identical to SEQ ID NO: 97427
  misc_feature 1..45: note = chr7:30603391-30603436
  misc_feature 1..45: note = Hypo
  source 1..45: mol_type = genomic DNA

SEQ ID NO: 127540 - DNA, 190 bp, Homo sapiens; identical to SEQ ID NO: 97428
  misc_feature 1..190: note = chr7:30687808-30687998
  misc_feature 1..190: note = Hypo
  source 1..190: mol_type = genomic DNA

SEQ ID NO: 127541 - DNA, 30 bp, Homo sapiens; identical to SEQ ID NO: 41248
  misc_feature 1..30: note = chr7:30699730-30699760
  misc_feature 1..30: note = Hypo
  source 1..30: mol_type = genomic DNA

SEQ ID NO: 127542 - DNA, 1256 bp, Homo sapiens
  misc_feature 1..1256: note = chr7:30721202-30722458
  misc_feature 1..1256: note = Hyper
  source 1..1256: mol_type = genomic DNA
gggaacttcaggcaacgggaacctacaatgagggaaggaggtttacactccaagaggaggaagtatttccttctcccctttttgggctgtcaccgcatggagcacgggaattgtgggcaaatcactggcttactgagattagacgctgtattgggggtagaagcagaaggcgcgcccccaacactgtaaggggtccttaacgcccgcggtccgcggtaccgcggccgtcagcagctttgtaccgctgggtccggaatcctctttactccctaaaccgccttctcaggaggccggtgtagagcaggcagcgagggccgggggcactcacgggtcgtgttgtacttgacgccgttgaagtactcggggcacggcctctccacgagggctccggcagcgctgcggggccagcacgttccgatctggtccaaggtcgtgttgcagtaggagtagggacctggcggcgggagagagcgcagtagggctcagaggggcccgcagggacgcggggctctcggagcgcggggtcaggggcgcacccagcgcgcgagagaaggagcccgcgcagcctccgaccgctcgcctcccgcctaccctcggggtccaggggtggcccccagccgtccaagagcagctcttcagccagcgccaggctgcagttggcctccagcaggctgtggagcagtgccgcgtccatcgcgtcccgcagccgcgtgcggagagggagtgggagtgcgcgcccggcgtgactgcgagggagtggacgcgagagtgagcggccgagagggcgcggggtcctggcccccgccagcccagccccgatctcccgggcagcctttgggcgccacctccggtcgcccagagctgtcaagtggggaccttcccggagaggagccgccgagtgcacggagctgcgggtacagccgctccgccgcggccaatggctgcgccggggggcggggccgggcggctcctctcggaggggctcagtctccagcccccgggccctccaccctgcccaaagtacggcttctcagttcgcagctctcttccactcgcggcgtccagaggagggcggtgggctggagagcgtgggcctggggtgacggaatgctctgtgcggggatcgcaggcccccgagctgcagggggcagcaaagcgcgcccacctgcccgcctgcccgaggagaacaccgcagctctgctaatcgagggacagccgcaacccaaagttcggcagctttccgcctgagcttcccc

SEQ ID NO: 127543 - DNA, 165 bp, Homo sapiens; identical to SEQ ID NO: 97435
  misc_feature 1..165: note = chr7:30744677-30744842
  misc_feature 1..165: note = Hypo
  source 1..165: mol_type = genomic DNA

SEQ ID NO: 127544 - DNA, 58 bp, Homo sapiens; identical to SEQ ID NO: 97436
  misc_feature 1..58: note = chr7:30780708-30780766
  misc_feature 1..58: note = Hypo
  source 1..58: mol_type = genomic DNA

SEQ ID NO: 127545 - DNA, 179 bp, Homo sapiens; identical to SEQ ID NO: 97441
  misc_feature 1..179: note = chr7:30899905-30900084
  misc_feature 1..179: note = Hypo
  source 1..179: mol_type = genomic DNA

SEQ ID NO: 127546 - DNA, 30 bp, Homo sapiens; identical to SEQ ID NO: 97442
  misc_feature 1..30: note = chr7:31018956-31018986
  misc_feature 1..30: note = Hypo
  source 1..30: mol_type = genomic DNA

SEQ ID NO: 127547 - DNA, 1295 bp, Homo sapiens
  misc_feature 1..1295: note = chr7:31091895-31093190
  misc_feature 1..1295: note = Hyper
  source 1..1295: mol_type = genomic DNA
gtgagcagggggaggcggtggtcggtcgcctccctccagcgcccagcctggcttcgcggcggaggcggcgcctctcccgcaggacggagccaagctggactgccgcgccgcgcggggcgggcaaagggggcgctgcgctcggccccgggcagggagtgacggcggcggcggcggctccgggcgagcgtggtccccgcgtgcgcacacgcacacgccgccgcgcagggacacacggaccccggccgccagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcaggtaagggtcgccccgccgcggctgcccctccacgcctcggccgtcttctccccctccagaaccttcgcccagccgggacctcggatcccctcctctggcttggcggtctccgccagccgcgacctccaccgacggagagcgggcgagggccggcgccaggcaagcctcccagatctgaaatgaagccccctcccgccgctgcgcccttcctgcgcgtcaggctgacaccccccaacccaagtgtctggcgctgcgctcggggcggccgatcgccgcagactgccggggtgggggtcgacctagctatctcacgcccctcctgatgcggagaagggagaccaggggggcaggcaagccatgcggccggagggacccggagggacatgcctccctacccttaggtggacggacgcacctacgcggatcgggaaggcagggctggagggtcccccggggctaggtaccgcaatccgcacggggtttgaggggtgggcaagcaatgtgctaggtgggggttggggtaggggccagtgtagaatgcccctctgtggtgacacatccgggattgttcaaaagagtgtcgtcttcgtttcccgtggcgcggaggggctggggttggggatgccagggcttcagtggtccccagaagaaacgccctgcggggtctgtggggaaacgcaccggccttcccaggttgaagtgggcccgctgagacccctgcctgccgctttagaggcagaagctcctgcggcggctgcggggggcggaggccacatcctcggcgggaccttggcaggttagggggctcagaagggacaggggagccgatggatgcaactagaccctcaggagggaacccagccggaagccgattgcatttcacgtggagctgaggag

SEQ ID NO: 127548 - DNA, 84 bp, Homo sapiens; identical to SEQ ID NO: 41251
  misc_feature 1..84: note = chr7:31116600-31116684
  misc_feature 1..84: note = Hypo
  source 1..84: mol_type = genomic DNA

SEQ ID NO: 127549 - DNA, 248 bp, Homo sapiens; identical to SEQ ID NO: 97448
  misc_feature 1..248: note = chr7:31118287-31118535
  misc_feature 1..248: note = Hypo
  source 1..248: mol_type = genomic DNA

SEQ ID NO: 127550 - DNA, 40 bp, Homo sapiens; identical to SEQ ID NO: 97449
  misc_feature 1..40: note = chr7:31232678-31232718
  misc_feature 1..40: note = Hyper
  source 1..40: mol_type = genomic DNA

SEQ ID NO: 127551 - DNA, 221 bp, Homo sapiens; identical to SEQ ID NO: 97451
  misc_feature 1..221: note = chr7:31375997-31376218
  misc_feature 1..221: note = Hyper
  source 1..221: mol_type = genomic DNA

SEQ ID NO: 127552 - DNA, 158 bp, Homo sapiens; identical to SEQ ID NO: 97452
  misc_feature 1..158: note = chr7:31518808-31518966
  misc_feature 1..158: note = Hypo
  source 1..158: mol_type = genomic DNA

SEQ ID NO: 127553 - DNA, 159 bp, Homo sapiens; identical to SEQ ID NO: 97453
  misc_feature 1..159: note = chr7:31528357-31528516
  misc_feature 1..159: note = Hyper
  source 1..159: mol_type = genomic DNA

SEQ ID NO: 127554 - DNA, 34 bp, Homo sapiens; identical to SEQ ID NO: 97454
  misc_feature 1..34: note = chr7:31939253-31939287
  misc_feature 1..34: note = Hypo
  source 1..34: mol_type = genomic DNA

SEQ ID NO: 127555 - DNA, 1017 bp, Homo sapiens
  misc_feature 1..1017: note = chr7:32110065-32111082
  misc_feature 1..1017: note = Hyper
  source 1..1017: mol_type = genomic DNA
tctcctcgcccagctcgcgatgcccagccaggcgcggcgcgcgtttgcccggcactttctcggcgcgctcccccttctgcgcccccagactccgacttagagcggactccgatcgcggcaaaccatggccccaggtgcgctccggaggcagctgcgggaaccagccatggtcccgggctaatgcccagggataagcacagggatagggatagagatagggattgggattggactccagctccaagagaaagcacctcgggtctattcgtattctccccctacccccaaacaaagccacagaagcgatcagcgcgcagctaaagggtttggaggtgaaaaggagggctgggtggggaggagagaaagtgagaagggagagaaaagcggcggctgagcaaagcgggagccggcgcgggcggtggggcctgacccggacgccgcgcacccggctccgccccgcgcccagcgccccgctcactccctggccgcgcctgccttcgcgcccctctgttttctctcacttaccagcagctctgctgacaagcgagaaaactgacaagtgagaaaagtcgtctgtcagcgcccgggctggtgtctgggctgtcaccgcgggcgcggagggaggggcgcgcgggcaccgccgtctgccgggcacacgctgggctccgaccccggccgggcacactcacccccgcagggcagccgcggccaccaccgacctgcggagctgcgtgggcttccggaaccctcacctcaacaagagctcggctccgcgcgcaagtaggagggaagggaaatccttatcctcccggggccagggcacgcagaagccgcgaggcttcgcggaggttgggcctggaggtcccccacagcctcactctcgcacccgccacagaaccggatccattttgaaatattgaagcgactgatggggacgaagggaaccacacaccacactcaaaaactcttgatgttttcttgctaaaggggctctctcgctcgcgctctctctcctcc

SEQ ID NO: 127556 - DNA, 158 bp, Homo sapiens; identical to SEQ ID NO: 41253
  misc_feature 1..158: note = chr7:32128181-32128339
  misc_feature 1..158: note = Hypo
  source 1..158: mol_type = genomic DNA

SEQ ID NO: 127557 - DNA, 16 bp, Homo sapiens
  misc_feature 1..16: note = chr7:32276939-32276955
  misc_feature 1..16: note = Hypo
  source 1..16: mol_type = genomic DNA
ccgcccatctcggcta

SEQ ID NO: 127558 - DNA, 30 bp, Homo sapiens; identical to SEQ ID NO: 41255
  misc_feature 1..30: note = chr7:32323599-32323629
  misc_feature 1..30: note = Hypo
  source 1..30: mol_type = genomic DNA

SEQ ID NO: 127559 - DNA, 1331 bp, Homo sapiens
  misc_feature 1..1331: note = chr7:32337766-32339097
  misc_feature 1..1331: note = Hyper
  source 1..1331: mol_type = genomic DNA
gtctgtcttgacgtccgcctctatctctggggcctaggtgtttctatcagtgtccccgtgtctggatgttcctgccgctctgtctgtgtgtctctatcatgtccacatcttcctgtcgctttctgtctccctctctcggcactatcttcatctctccatcgcagcgtctccagccctatttccacccctcctttcccccggcctgccttattaaaatcgcagccaggaaaccgagcagttcggggaggtgtgatgctgaaaaccagcttccgcgcgacgccgggtcggagcccgcgaggggtgccgggggggacagcccagggtgcggcttctgtcccgacccagtcgccgctcccgggggctcccgcccggagagcaccctccggccccagcccgacccctgagctccccctgcccgcttagaaaggaactctgaccgccaccggagagggcgtttgcccgagccaggagtccgagaggggtggaaagttctcacctatggtgaagctgtagccatcgatgctgaaagtggcgctccggcattttttgaagccctccttcctgttgccggcgtccgtcatggctcggccggccgggcaggggcctcgcagcgagaccagcggcgtctgcggtcccccccacggcggagtgagcagcccggggctcggcggcgaatcctcccccggccgcgccgcgctgtcactctcagccccgccgcgcgctggcagctgagcgcctggagacaacagcggggacccaatgtcaacagctaaagcgctaggagctcggcggaggcaggagccgtcgcgactgccccatctccaagccgagttccagaggcggcgagaggagtgtcaggaagggaggacgcgcgcccgagcgcgtggacggggctgaccggtgggcgcggagatccctgcctggccacgctactctctgtcagccgcggatcccgcgcgccacaggaaagtctgttttctacttcaccttctccttccgtctctggtggctggggggatttggggacccaagggaatggctgaattggcgtcgtgcgtcttctagatatgttttctctggcagaccggggagcttccagaaagcacatcaacagatggaaaggcaaacccctcagccatgagatgttgccgaagtttactccaaacaaggaagtcgggaaaatcgccacgcccacttccttctagccactgcccccagcactggcctggagccccgatagtgtttcttctccactgtccctgccaggaaggtaattgtcaaagtcaccggaggctctatgatgtgaaatgtacaatcgaattagaactcgc

SEQ ID NO: 127560 - DNA, 903 bp, Homo sapiens
  misc_feature 1..903: note = chr7:32467159-32468062
  misc_feature 1..903: note = Hyper
  source 1..903: mol_type = genomic DNA
ttctccccatggtgccggccccggtactaagctggggaaagggatccttagggtgtaaactgtcttgccacctactgtttaaacctctgtgaaagataagccttctgaaatagcctcctattcaacccagaaatcaatcctaacttgtaaaagaagttatggacacgaggacgagaaacgggaaatcctgcgggagatagcgctttctcttttcccccagaaagtctccaggcagcagctctgtgagatccttaagcaaggtaaggaaactcacccgctgcgctgcggcttcgtggccagcagggctgggacatactcgcctcacgcttcagcaccggggacagctcctgcctcgccaacttcggcagctcttctcgatgtctcgccgcgggctgtgcctcacaggctacgggaggggagagtgtctccccacgccggggtcccggcctctgggttttagggagcgcgaatgggtctccgacagcaacgggagcagccggtggcgcctcaggctgcggtggcaacgagcccgactgcactacggctttgcgggaccgcgccagcgcggaggagaccgagcccatctcagcgggccgggccggacccaggtgagcggccctggctccccgaggaatccacggccctcgcctgccgaaggcttactccctcctggtgccggggcgcccccagctgtctgctccgcctctgaccctgcgggctgcagcgaaggctgcgcgcccacccgcgggggaccggaacggagggtaatgcgggcggtgtccgcgcccgcctaacagtctggggtggatgggacttggggagtcgctatatagaggctgtccggaggctttactggaaattgaggggaggaaggggcgtggcattaggcgagggatacttttt

SEQ ID NO: 127561 - DNA, 30 bp, Homo sapiens; identical to SEQ ID NO: 8997
  misc_feature 1..30: note = chr7:32468472-32468502
  misc_feature 1..30: note = Hyper
  source 1..30: mol_type = genomic DNA

SEQ ID NO: 127562 - DNA, 89 bp, Homo sapiens; identical to SEQ ID NO: 97470
  misc_feature 1..89: note = chr7:32801573-32801662
  misc_feature 1..89: note = Hyper
  source 1..89: mol_type = genomic DNA

SEQ ID NO: 127563 - DNA, 158 bp, Homo sapiens; identical to SEQ ID NO: 97477
  misc_feature 1..158: note = chr7:32982112-32982270
  misc_feature 1..158: note = Hyper
  source 1..158: mol_type = genomic DNA

SEQ ID NO: 127564 - DNA, 438 bp, Homo sapiens; identical to SEQ ID NO: 97478
  misc_feature 1..438: note = chr7:32996944-32997382
  misc_feature 1..438: note = Hyper
  source 1..438: mol_type = genomic DNA

SEQ ID NO: 127565 - DNA, 77 bp, Homo sapiens; identical to SEQ ID NO: 97484
  misc_feature 1..77: note = chr7:33545157-33545234
  misc_feature 1..77: note = Hypo
  source 1..77: mol_type = genomic DNA

SEQ ID NO: 127566 - DNA, 2103 bp, Homo sapiens; identical to SEQ ID NO: 97485
  misc_feature 1..2103: note = chr7:33943451-33945554
  misc_feature 1..2103: note = Hyper
  source 1..2103: mol_type = genomic DNA

SEQ ID NO: 127567 - DNA, 30 bp, Homo sapiens; identical to SEQ ID NO: 97486
  misc_feature 1..30: note = chr7:33963977-33964007
  misc_feature 1..30: note = Hypo
  source 1..30: mol_type = genomic DNA

SEQ ID NO: 127568 - DNA, 25 bp, Homo sapiens
  misc_feature 1..25: note = chr7:35190140-35190165
  misc_feature 1..25: note = Hypo
  source 1..25: mol_type = genomic DNA
atcttttttttgagacggggtcttg

SEQ ID NO: 127569 - DNA, 1455 bp, Homo sapiens
  misc_feature 1..1455: note = chr7:35225273-35226728
  misc_feature 1..1455: note = Hyper
  source 1..1455: mol_type = genomic DNA
aagactcaagaaaagcgccatgcggctccctcctagggctctcctgccctctccttaccgatgctgagagtggttctgctggggaaccaccgcgcctgcagttcgtgcacctcttcccggagctgcgccagggaattacggacgaactggaaggggtcgagaagggtcttggccaccacctttagctccaagccttttcgctttttcagatttgggatcctccccggggaggacctcctggcgccccctggcagtttcccgccgcctagggccgacttttccacctccagctcccgggcgggggaggccccgtacggccgcttagacgggctggggcgggaagattgcagcggctttgggtttactccttgtttcttcataatccctagtggagctgggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtgaaatgtagggtggagcgcatgcgttcgaagccattcgcgcgggcagtccctgcgtgtccccctgcgtgtccccccacgtgctccccagcgcgcgcagcaccccgcctctgcgcttccccgagcgtgcagcttccggtgagggcagccccacgcacagcccccaacaccctccccagcgcctgcagccttcggtgcgcgcagtccccaagcccacatgcgcagttctcaccttgcgcgcagccccacgtacagcccccaacacgctcccagccccactggcgcagaacccatcaccgcttgcccttcacgcgcttcattgggagtgcagctcccaccccgagcgcgcagctccacgcagcctctccacactctccccagcgcttgcagcaccccccagtgcgcacagctctgccagtagcttcccggcgcgccgcccctgcaccgcttcgggccataaccttgctggcgactaagtctgaagaacttcctgtggtttcattcttttcttcaggtttagtcttagctctgacattttaaccaaaaggttacacgttaattaacgaggtattaaaggggaagatctcagctgaaagaaatgactgtaggaagtgtgtcagggaagccaacggaaccgctggcccgccggtggtgcgcccggcattaggaaagtctctacgatcgctgaggtatcgggcagtcagtgcccgttgccaacgcggagggaacgggcggagactgcgggcaacacgtggcagagccggcgtgagtccggtgggtctgatcccagagcctcaggttgacgccacttccttggcacggaacagcgtttactgaatcttagagcaaaatgcttttccaatgaggttcctcagaagtcatcggccctaggagcggtgtgctcaagcgctttcagcaccag

SEQ ID NO: 127570 - DNA, 1800 bp, Homo sapiens
  misc_feature 1..1800: note = chr7:35292877-35294677
  misc_feature 1..1800: note = Hyper
  source 1..1800: mol_type = genomic DNA
gacaacttaggagaccgacgggcccagatataagatgcacattcacagcattcaacagactgaagcctccaaagaaaacttggacccaaaagaaaaagatctcccacccgcgatgtatggctcatggcttgagcatcagacgttgctgcgagccgcctgcagccaggggcacagacggatgcgcagcatccccagtcctcggcggacagccgggtagcccaacttacccaggggtttgattgtgttctccgtcgcctccttctccttagagccgccgctcgacatgagcgcggcaatggagaaggcgttggcccgagaggagagttggggcttgggggacgccgtgaactccatggtccccagcacgcggtcctggccagggacggggtcgtccgaactgccgtccagattccccaagggagacaaagacccgaaacacagctcaaagtttccgagagcagtcacagcggggccagggactccagaagtgtcagctccaacgactccagagctgcacactggcctctattccccaccgcaaagccccagagccgcagagacttcgaaggcagccggagaggagagggcccaccgagcactacggcgggtgcgcacgccccggggcgctcggcaggacgacagtctgcacagcccgaaggcggaaacgagcatcaactgcacaaagtcctggggtcctggagcatcccctccgcgtccttcctccctctggggctggggacagccgggatgtcccaggctgaggtggccaccagccgagcgcggctgctaggacgctggcgtggggagcgcggcgcggaactacggacagtgagccctggcgctcgctgccctgcgccttaatttgctggcggcggcgatcccggaggcccgcagccagtcagcgccgtctcacgtcaccgcttcctgattccgccgccgggggcggggccgcgggccgggcgcggagggcgcgcccagggtgcggcgcccgcgtggcctgtcgccccggctgttcggtaccccagcacaggttcagggaaaagggtgccaccactaggctgacgcagcagccatggacatccccacctggtctcacagccccgggcgggagggcggtgcgcgctgtcgggagaggacacatcaccgcggcctaacgcccgagatccgggcatggcccagttggggaagctatgaccagaccagtggaagcctcgggagttctcgctttttccattctttttcttacctgcgctcaaagttccaaaagaaagtagggaagcgctcagtagaatccggcgcctctgagccggcgccaactggccaggtccatactcggggcagatcccagggctgggactctcattcgatggtcccaaatttgatctctttgacagtggggctgagcaaatgcagccctgaaaaagataagcttagcgagagctgcgggcatttggcaaaggatgctgctctcagaaccgtggcttctgctcctcaccagtgcgtctctagcctggggctcctattttccctagagggaccctggaaaatgggacggctgccgaagagaaggcgaaggtcagggcgcggagctctacggtaaccacgcgacgcgtagtgggagagtgcgaaccttatggtagcgcccggactaagcggacacagacccctctggttttacaaaggcggctgtgacgaggacttcccacggccttgttggagggcgtcctgttagccctgctcagcctgaataactcaaattctccgaattcgcagggtaatccgcttcgcttggagccgtgt

SEQ ID NO: 127571 - DNA, 30 bp, Homo sapiens
  misc_feature 1..30: note = chr7:35295077-35295107
  misc_feature 1..30: note = Hyper
  source 1..30: mol_type = genomic DNA
gctggaaggaatttacgctgtcttctagcc

SEQ ID NO: 127572 - DNA, 32 bp, Homo sapiens; identical to SEQ ID NO: 97498
  misc_feature 1..32: note = chr7:35295864-35295896
  misc_feature 1..32: note = Hyper
  source 1..32: mol_type = genomic DNA

SEQ ID NO: 127573 - DNA, 1433 bp, Homo sapiens
  misc_feature 1..1433: note = chr7:35296739-35298172
  misc_feature 1..1433: note = Hyper
  source 1..1433: mol_type = genomic DNA
ccgtttaaactttggcgcctaagaatgtaaaattttgttatacatctgagtttgtttatatggaatttgattatatggaagactggaagatgtctccttatatacaccactctttcaaattctcatttgtagctcccggaactcagaagacagtcgacccccaaaactgtccaggaagtaatcggtttccggcttttggacaatggtccctcgcttaacgaatgctaacgaatgctcccttagctgggagctgcagggaccggtcccggcaggtctaaccaaccgtccgcaggcgccgtggtcgagagcagagccgagacggcggggcagggtgccaagcggagggcacagcctggcagccaccgttggcggcaggagagaatgggagaagggagacccgcttctcagcacaagggcatctgtctactcccgaacatggccggagattcctgtccacagcctccctccagctctttctggtagacactttaaaagcgacattaacgggcttcggtgcctttggattcctaaattaggtttacggaaaaggaaagacttcccaagaacagtgagaagaggaactgcagcccctccaaggccgctgcggcgcgttcccggggcgcgccgagagcagcgcgcggctccgtgccccgtggggagcgcgcggcgcggccttggatttcaccgcgagtcgggagggcgggtctgagccttgcctcccaggatccttccgacgaacaccccgcgggttttagtttatcgagccaaagtggtcccggagaagcgctccctcgcagccaagctgcaagaagtggccgggaacctacaggcctcgggccgacccaggaagcctccgcaccagaaagctcgaggagcccttacccaagtcttgctcgaagggcaaagcaaagagccagcacccctgagtgtcactgaagttcctggatggggtgtgagtgcgcgcgttccgtccgagacctcagtctcgcccagctatagagccgataaagggatgtcttgtgggcgtaaggcgcttcgcgcccatctccaaggccgatgtggtcaggaggtgaggggaaatgtccttctggcagaagcccgcggtgctgcgacgttgacccgcctggcctcaggctcagggcggcgggcagcccagggcacatgtagtttcagcagccgcgctacgtgggcgggggaccccaggccaccccacgtgtccgccctgggcctcctccgggtcccaaggcgcggcgcctccaggccttgtagcgtcttccccgggtccccgcgcgccaggccccgcagcctgctcacaggacagccctcggggctgcgaccctctcgctcctccccgcggccactcgctccccgttcatcccccacgagctcactaccgcagggaccggccctcagagccccgggcctcctcccgg

SEQ ID NO: 127574 - DNA, 1188 bp, Homo sapiens
  misc_feature 1..1188: note = chr7:35300778-35301966
  misc_feature 1..1188: note = Hyper
  source 1..1188: mol_type = genomic DNA
ggtctttctgccgcacgtggacaacgggcccgggcggcctttgtaatgttattttttcttttctgaagataattacctagtattctgcaggttcctctggtgcaacagagactgccgcggggcgggggagaaggtggtgaggggggtcgcgcatcgctcagtgcaggtctgtgctttcacttggcctgcgctcaggtcagtgcgccccttaccggagcacccatggcctcccgcgttaccccaaattttgtaggcagactgtcagagttcgaagccagctgtgtcctctgcgggccgtgtgaccctaggctatctgggctgctcggagccttagtttccctagttgtgaagagggagggtgtgaccatggcccggagctctccgaaaggctgtgcggattgctcggtggcgggatgtggagcgcgtcttctatgatgccaggtgctggccaagcgctcgatgcaggctgctccagttaggtcgatgcgatggcgggaagcactttcctctgcaatggagagacgccgacaccccgagcccgaaggcttgcaaggcgcgctctcgccactggggtcggggatccgtgggttctctatcccgcttacccactccatccttagcagctgtcgtcggtcccagacctctaccttggagagaccaaggcggcccagagcccaggagactactgcgcggtacgccaggatccagaagtggattctgacttctaaagacccctcccaagccaacgctatcagggtccctgcaagcggttgactgtggcggaggcagaaccaaaacctttgctctgcccgcggcgctccagcctctcacccaggacagtgctctgggctccagccgctgcagtggggtcgggacacagacgccgagttagaagccccgccgctgcaggtccctgcttggtcggcgcggtgacggtgtcgctggcggcggcgggggccttcctttggctgcccggccatttaatcagagctattatcagacagggcttgcaggatggcgccggccgagctttacccccattagcacagggcaggctgggggctgggtcctgaggccaccgccggtcccggccagctgcagcttttctggggagctatgagaaaggcaggcctggtggctccggccttctctacccggccactctcaggctgacgagttattagaatt

SEQ ID NO: 127575 - DNA, 25 bp, Homo sapiens
  misc_feature 1..25: note = chr7:35327606-35327631
  misc_feature 1..25: note = Hypo
  source 1..25: mol_type = genomic DNA
catgagccaccgagcctggccagaa

SEQ ID NO: 127576 - DNA, 87 bp, Homo sapiens; identical to SEQ ID NO: 97506
  misc_feature 1..87: note = chr7:35350106-35350193
  misc_feature 1..87: note = Hypo
  source 1..87: mol_type = genomic DNA

SEQ ID NO: 127577 - DNA, 146 bp, Homo sapiens
  misc_feature 1..146: note = chr7:35494329-35494475
  misc_feature 1..146: note = Hyper
  source 1..146: mol_type = genomic DNA
gcgccggccaatcagcgtatggctcagtcccgcgggccccgcttccaggtggagctgctcctgctctcggggtagccagggtcccgggcctggccgcggccccgcgggctcttacgctttcgcccccatctcgctccgcacgccag

SEQ ID NO: 127578 - DNA, 185 bp, Homo sapiens; identical to SEQ ID NO: 97510
  misc_feature 1..185: note = chr7:35579059-35579244
  misc_feature 1..185: note = Hypo
  source 1..185: mol_type = genomic DNA

SEQ ID NO: 127579 - DNA, 30 bp, Homo sapiens; identical to SEQ ID NO: 97511
  misc_feature 1..30: note = chr7:35689006-35689036
  misc_feature 1..30: note = Hypo
  source 1..30: mol_type = genomic DNA

SEQ ID NO: 127580 - DNA, 138 bp, Homo sapiens; identical to SEQ ID NO: 97512
  misc_feature 1..138: note = chr7:35839940-35840078
  misc_feature 1..138: note = Hyper
  source 1..138: mol_type = genomic DNA

SEQ ID NO: 127581 - DNA, 88 bp, Homo sapiens; identical to SEQ ID NO: 41257
  misc_feature 1..88: note = chr7:36428640-36428728
  misc_feature 1..88: note = Hypo
  source 1..88: mol_type = genomic DNA

SEQ ID NO: 127582 - DNA, 30 bp, Homo sapiens; identical to SEQ ID NO: 97514
  misc_feature 1..30: note = chr7:36441223-36441253
  misc_feature 1..30: note = Hypo
  source 1..30: mol_type = genomic DNA

SEQ ID NO: 127583 - DNA, 30 bp, Homo sapiens; identical to SEQ ID NO: 97515
  misc_feature 1..30: note = chr7:36923939-36923969
  misc_feature 1..30: note = Hypo
  source 1..30: mol_type = genomic DNA

SEQ ID NO: 127584 - DNA, 98 bp, Homo sapiens
  misc_feature 1..98: note = chr7:37025520-37025618
  misc_feature 1..98: note = Hypo
  source 1..98: mol_type = genomic DNA
tactcaccaagctcccgtaagtccatctttcccaaccacaaatactgattctaagctgctgccaccacaaagcgacttagagtcgtccccctgaagaa

SEQ ID NO: 127585 - DNA, 60 bp, Homo sapiens; identical to SEQ ID NO: 97518
  misc_feature 1..60: note = chr7:37136264-37136324
  misc_feature 1..60: note = Hypo
  source 1..60: mol_type = genomic DNA

SEQ ID NO: 127586 - DNA, 39 bp, Homo sapiens; identical to SEQ ID NO: 97519
  misc_feature 1..39: note = chr7:37211371-37211410
  misc_feature 1..39: note = Hypo
  source 1..39: mol_type = genomic DNA

SEQ ID NO: 127587 - DNA, 30 bp, Homo sapiens; identical to SEQ ID NO: 14984
  misc_feature 1..30: note = chr7:37264509-37264539
  misc_feature 1..30: note = Hypo
  source 1..30: mol_type = genomic DNA

SEQ ID NO: 127588 - DNA, 181 bp, Homo sapiens; identical to SEQ ID NO: 14985
  misc_feature 1..181: note = chr7:37279183-37279364
  misc_feature 1..181: note = Hypo
  source 1..181: mol_type = genomic DNA

SEQ ID NO: 127589 - DNA, 30 bp, Homo sapiens; identical to SEQ ID NO: 97523
  misc_feature 1..30: note = chr7:37347397-37347427
  misc_feature 1..30: note = Hypo
  source 1..30: mol_type = genomic DNA

SEQ ID NO: 127590 - DNA, 119 bp, Homo sapiens; identical to SEQ ID NO: 41261
  misc_feature 1..119: note = chr7:37399153-37399272
  misc_feature 1..119: note = Hypo
  source 1..119: mol_type = genomic DNA

SEQ ID NO: 127591 - DNA, 24 bp, Homo sapiens
  misc_feature 1..24: note = chr7:37423707-37423731
  misc_feature 1..24: note = Hypo
  source 1..24: mol_type = genomic DNA
gtgcccggccgaaacatacaggtt

SEQ ID NO: 127592 - DNA, 208 bp, Homo sapiens; identical to SEQ ID NO: 97526
  misc_feature 1..208: note = chr7:37424312-37424520
  misc_feature 1..208: note = Hypo
  source 1..208: mol_type = genomic DNA

SEQ ID NO: 127593 - DNA, 43 bp, Homo sapiens; identical to SEQ ID NO: 97527
  misc_feature 1..43: note = chr7:37446822-37446865
  misc_feature 1..43: note = Hypo
  source 1..43: mol_type = genomic DNA

SEQ ID NO: 127594 - DNA, 30 bp, Homo sapiens; identical to SEQ ID NO: 97528
  misc_feature 1..30: note = chr7:37484434-37484464
  misc_feature 1..30: note = Hypo
  source 1..30: mol_type = genomic DNA

SEQ ID NO: 127595 - DNA, 138 bp, Homo sapiens; identical to SEQ ID NO: 97529
  misc_feature 1..138: note = chr7:37487113-37487251
  misc_feature 1..138: note = Hyper
  source 1..138: mol_type = genomic DNA

SEQ ID NO: 127596 - DNA, 1817 bp, Homo sapiens
  misc_feature 1..1817: note = chr7:37487371-37489188
  misc_feature 1..1817: note = Hyper
  source 1..1817: mol_type = genomic DNA
cggcacagcaccgacttcccaaccccaaacacacgcgcgcacccccgggacagctgagttctgtatttcctcttcctcaaagcgactccggcgatcgcagtcgccactctccgctccgattcccgggccccctggcatgccgccgcccccttctctgaaggcgcgcccggtgcgtcccctctccgaagccgagatttccacgaagctccacaaagctccccgccgcctctctcggtctcggcggagaccccggtgtgtccccgggaggagagtatttactaaccagaacctcaggggctcccggctgcccagaccgccctctccggccctcctggcccccattcctctggcccatcaccgccccctcccacgagcgcgctcgccgggggattccctcccatccccgagtgcaggagaagacgccgagtctgagccgcagccgcttctctagctctataggaatcttgactccaagatcccagccccacatcccccgtccccagtaaccccgcgccagcgtcgcaaccctcccgcgccccccctcccgcagaccctggtcgaaatgtctcggcgggctcccgggccccgggccctgcgcttcatccgcgggcgccgcacctccagcgccccctccctccgctcccactcccactcccgccatccccggagctcagacttccccaactgcagagcgccccgacgcgcccgcagccctcaccctgccgagcgcggcggccacccccgcccgagccgcggcgcccccagggaggaaacaaaagtgtctccgcggcgcccggagtcccccggagcaggacgcctcctcccggccccagtcccggccccctcccctgccgcgccgaggtcagcgagtcggggcgcggcgccagcccaggaaactttacgaacctgcttggggtcgcaggacagcagcggcaagggttcccggcgatcagagctccggcgacccgccaccattgaaggggaactggaggctctgtcgcccagcgtggggccgcggcggcgtgggtggctctgcctctatcctgtgcccatcctcgcccgctcccgctcgccccagcacacgcacttacactctgggtcggccggctgctgcaccgccggctgccgctgctctcacttcctcttccttcctcctgctggccagagacacattttgcatctgcaaggcatccggagatcagccgcgaactctcctcccgagcggacgctgcggagttgcagccgccgcccccggcacctgcgccaggacactcgtggtctgcgcgttcgccttgcgcccgcaccctgcctggtccctgcccactgcactttgcctagggggatgcccacgactttttgaagtccccctacttaaaagacagaaatgtcaaacaccatgcatgcctcagatctgctataaataatatgtgtgcagagcatgacttcgatgagctcacacacggcgtttggaggcactaattaactccgtcaccctcatagcgccatctccgggaggccaaaagcgagtagcatcttttcacatccttttttaatttttggcaaccggttccggatattaaggggaaacttcggtgggctgtttgaacgctactttaagacgtgtttgttttgacgctgtgcctctacccttggacagagtggcaaaaaaaaaaaaaaaaagtttcctccctctccgtcgacatctatgtatttactaaccctgcaattgaaactacaagatgtatttctaaccaattaagccagggacttcctaattttgcataactttgcataaggcaagacgttccacccataat

SEQ ID NO: 127597 - DNA, 30 bp, Homo sapiens; identical to SEQ ID NO: 97533
  misc_feature 1..30: note = chr7:37533583-37533613
  misc_feature 1..30: note = Hypo
  source 1..30: mol_type = genomic DNA

SEQ ID NO: 127598 - DNA, 30 bp, Homo sapiens; identical to SEQ ID NO: 41265
  misc_feature 1..30: note = chr7:37686948-37686978
  misc_feature 1..30: note = Hypo
  source 1..30: mol_type = genomic DNA

SEQ ID NO: 127599 - DNA, 142 bp, Homo sapiens; identical to SEQ ID NO: 97536
  misc_feature 1..142: note = chr7:37727598-37727740
  misc_feature 1..142: note = Hypo
  source 1..142: mol_type = genomic DNA

SEQ ID NO: 127600 - DNA, 146 bp, Homo sapiens; identical to SEQ ID NO: 97537
  misc_feature 1..146: note = chr7:37770953-37771099
  misc_feature 1..146: note = Hypo
  source 1..146: mol_type = genomic DNA

SEQ ID NO: 127601 - DNA, 178 bp, Homo sapiens; identical to SEQ ID NO: 97538
  misc_feature 1..178: note = chr7:37835728-37835906
  misc_feature 1..178: note = Hypo
  source 1..178: mol_type = genomic DNA

SEQ ID NO: 127602 - DNA, 187 bp, Homo sapiens; identical to SEQ ID NO: 97539
  misc_feature 1..187: note = chr7:37868787-37868974
  misc_feature 1..187: note = Hypo
  source 1..187: mol_type = genomic DNA

SEQ ID NO: 127603 - DNA, 30 bp, Homo sapiens; identical to SEQ ID NO: 97540
  misc_feature 1..30: note = chr7:37888029-37888059
  misc_feature 1..30: note = Hypo
  source 1..30: mol_type = genomic DNA

SEQ ID NO: 127604 - DNA, 30 bp, Homo sapiens; identical to SEQ ID NO: 41268
  misc_feature 1..30: note = chr7:37907440-37907470
  misc_feature 1..30: note = Hypo
  source 1..30: mol_type = genomic DNA

SEQ ID NO: 127605 - DNA, 30 bp, Homo sapiens; identical to SEQ ID NO: 97542
  misc_feature 1..30: note = chr7:37953791-37953821
  misc_feature 1..30: note = Hypo
  source 1..30: mol_type = genomic DNA

SEQ ID NO: 127606 - DNA, 419 bp, Homo sapiens; identical to SEQ ID NO: 97543
  misc_feature 1..419: note = chr7:37955637-37956056
  misc_feature 1..419: note = Hyper
  source 1..419: mol_type = genomic DNA

SEQ ID NO: 127607 - DNA, 308 bp, Homo sapiens; identical to SEQ ID NO: 31238
  misc_feature 1..308: note = chr7:37956260-37956568
  misc_feature 1..308: note = Hyper
  source 1..308: mol_type = genomic DNA

SEQ ID NO: 127608 - DNA, 794 bp, Homo sapiens
  misc_feature 1..794: note = chr7:37960164-37960958
  misc_feature 1..794: note = Hyper
  source 1..794: mol_type = genomic DNA
ccccctcttaaaacacgatgcctcccaggatgctagtggcaccactgccactgcatttcctgttggcagcagtgagcagtgaaaaccgaagcggcagaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgaccgcgatgccaggacgcgctcccctccgcaccgtcccgggcgccctgggtgcctggctgctgggcggcctctgggcctggaccctgtgcggcctgtgcagcctgggggcggtgggagccccgcgcccgtgccaggcgccgcagcagtgggaggggcgccaggttatgtaccagcaaagtagcgggcgcaacagccgcgccctgctctcctacgacgggctcaaccagcgcgtgcgggtgctggacgagaggaaggcgctgatcccctgcaagaggtacaggtcatcggcccgcggggcgggagtagggagccgcgcgggcatggggagggcgaggtcgcagaggcctgcgccctgtaactctttccggccccttgcagctcctcccttctcccagagagatctttcgcgaggagggtctctt

SEQ ID NO: 127609 - DNA, 41 bp, Homo sapiens; identical to SEQ ID NO: 97547
  misc_feature 1..41: note = chr7:37961158-37961199
  misc_feature 1..41: note = Hyper
  source 1..41: mol_type = genomic DNA

SEQ ID NO: 127610 - DNA, 30 bp, Homo sapiens; identical to SEQ ID NO: 97548
  misc_feature 1..30: note = chr7:37962835-37962865
  misc_feature 1..30: note = Hypo
  source 1..30: mol_type = genomic DNA

SEQ ID NO: 127611 - DNA, 30 bp, Homo sapiens; identical to SEQ ID NO: 41269
  misc_feature 1..30: note = chr7:37969938-37969968
  misc_feature 1..30: note = Hypo
  source 1..30: mol_type = genomic DNA

SEQ ID NO: 127612 - DNA, 38 bp, Homo sapiens; identical to SEQ ID NO: 97550
  misc_feature 1..38: note = chr7:37973881-37973919
  misc_feature 1..38: note = Hypo
  source 1..38: mol_type = genomic DNA

SEQ ID NO: 127613 - DNA, 30 bp, Homo sapiens; identical to SEQ ID NO: 97551
  misc_feature 1..30: note = chr7:38044515-38044545
  misc_feature 1..30: note = Hypo
  source 1..30: mol_type = genomic DNA

SEQ ID NO: 127614 - DNA, 37 bp, Homo sapiens; identical to SEQ ID NO: 41270
  misc_feature 1..37: note = chr7:38170685-38170722
  misc_feature 1..37: note = Hypo
  source 1..37: mol_type = genomic DNA

SEQ ID NO: 127615 - DNA, 30 bp, Homo sapiens; identical to SEQ ID NO: 97555
  misc_feature 1..30: note = chr7:38422917-38422947
  misc_feature 1..30: note = Hypo
  source 1..30: mol_type = genomic DNA

SEQ ID NO: 127616 - DNA, 97 bp, Homo sapiens; identical to SEQ ID NO: 97556
  misc_feature 1..97: note = chr7:38508402-38508499
  misc_feature 1..97: note = Hypo
  source 1..97: mol_type = genomic DNA

SEQ ID NO: 127617 - DNA, 868 bp, Homo sapiens
  misc_feature 1..868: note = chr7:38670306-38671174
  misc_feature 1..868: note = Hyper
  source 1..868: mol_type = genomic DNA
agcactgtgtgatcacgatcctaccctattggtcctgggagatttttggtggcttctctgttaaatcgttcgtgtctgctgcacttaagtagccacaaaatcccccgcaagaaggaaggctgctgcaatctcccgccccgatctgcgggccgcgtccccgcgagctgcctgcgggcgcgctgggagccggcccggggagatgcgagcgcagggagatgcgctctgctccgggcgcagcgggcaagctgccgcacctcctacttctgttgcctggcttggggccaggagagcggcaacccggggccggctccggagctggacatatccggcgtctccggggccagggtctgcgggtccccggcgctgcgtcctcccgacccgctccccgcggcgcccgggtcgcgccttgcggcagtcaccgagctgagggcagggcgtcccagcgtccctggccccggccccgctccgcagcgcgccgcaccccgaggctcgggccccgcacagctgcagccggtgccctccggccaagcccccgcctggcgtccccggccccagccccggccgcccgccgctgaccttttcctgcgcgcggttgagtcgcttctggacgttcttggcgaagatgcccgtcttgatgtcggccatggctgcgggtccggggagctgcgaagagcagagcgcgcagcggggctggcggcggcgcggaggagcgggaggaggagcgggaggaggaggagagggccgagcaagggaggagcgggagaagcggcggggagccgcggagcgcggaggggtgagggcggggcgcggcggcgggaccagcttaaagcgacagagcgggggcgggatgcgtcgggactggctgtga

SEQ ID NO: 127618 - DNA, 79 bp, Homo sapiens; identical to SEQ ID NO: 97560
  misc_feature 1..79: note = chr7:38731677-38731756
  misc_feature 1..79: note = Hypo
  source 1..79: mol_type = genomic DNA

SEQ ID NO: 127619 - DNA, 195 bp, Homo sapiens; identical to SEQ ID NO: 97561
  misc_feature 1..195: note = chr7:38740329-38740524
  misc_feature 1..195: note = Hypo
  source 1..195: mol_type = genomic DNA

SEQ ID NO: 127620 - DNA, 30 bp, Homo sapiens; identical to SEQ ID NO: 97562
  misc_feature 1..30: note = chr7:38752794-38752824
  misc_feature 1..30: note = Hypo
  source 1..30: mol_type = genomic DNA

SEQ ID NO: 127621 - DNA, 536 bp, Homo sapiens; identical to SEQ ID NO: 97565
  misc_feature 1..536: note = chr7:39015528-39016064
  misc_feature 1..536: note = Hyper
  source 1..536: mol_type = genomic DNA

SEQ ID NO: 127622 - DNA, 30 bp, Homo sapiens; identical to SEQ ID NO: 97566
  misc_feature 1..30: note = chr7:39056562-39056592
  misc_feature 1..30: note = Hypo
  source 1..30: mol_type = genomic DNA

SEQ ID NO: 127623 - DNA, 30 bp, Homo sapiens; identical to SEQ ID NO: 41273
  misc_feature 1..30: note = chr7:39192698-39192728
  misc_feature 1..30: note = Hypo
  source 1..30: mol_type = genomic DNA

SEQ ID NO: 127624 - DNA, 199 bp, Homo sapiens; identical to SEQ ID NO: 97568
  misc_feature 1..199: note = chr7:39317796-39317995
  misc_feature 1..199: note = Hypo
  source 1..199: mol_type = genomic DNA

SEQ ID NO: 127625 - DNA, 763 bp, Homo sapiens; identical to SEQ ID NO: 97570
  misc_feature 1..763: note = chr7:39453541-39454304
  misc_feature 1..763: note = Hyper
  source 1..763: mol_type = genomic DNA

SEQ ID NO: 127626 - DNA, 57 bp, Homo sapiens; identical to SEQ ID NO: 97571
  misc_feature 1..57: note = chr7:39873278-39873335
  misc_feature 1..57: note = Hyper
  source 1..57: mol_type = genomic DNA

SEQ ID NO: 127627 - DNA, 101 bp, Homo sapiens; identical to SEQ ID NO: 41275
  misc_feature 1..101: note = chr7:39921805-39921906
  misc_feature 1..101: note = Hypo
  source 1..101: mol_type = genomic DNA

SEQ ID NO: 127628 - DNA, 93 bp, Homo sapiens; identical to SEQ ID NO: 97577
  misc_feature 1..93: note = chr7:40157085-40157178
  misc_feature 1..93: note = Hypo
  source 1..93: mol_type = genomic DNA

SEQ ID NO: 127629 - DNA, 37 bp, Homo sapiens; identical to SEQ ID NO: 97578
  misc_feature 1..37: note = chr7:40401724-40401761
  misc_feature 1..37: note = Hypo
  source 1..37: mol_type = genomic DNA

SEQ ID NO: 127630 - DNA, 142 bp, Homo sapiens; identical to SEQ ID NO: 97579
  misc_feature 1..142: note = chr7:40407687-40407829
  misc_feature 1..142: note = Hypo
  source 1..142: mol_type = genomic DNA

SEQ ID NO: 127631 - DNA, 159 bp, Homo sapiens; identical to SEQ ID NO: 97581
  misc_feature 1..159: note = chr7:40603511-40603670
  misc_feature 1..159: note = Hypo
  source 1..159: mol_type = genomic DNA

SEQ ID NO: 127632 - DNA, 30 bp, Homo sapiens; identical to SEQ ID NO: 97584
  misc_feature 1..30: note = chr7:40938913-40938943
  misc_feature 1..30: note = Hypo
  source 1..30: mol_type = genomic DNA

SEQ ID NO: 127633 - DNA, 46 bp, Homo sapiens; identical to SEQ ID NO: 97585
  misc_feature 1..46: note = chr7:40943566-40943612
  misc_feature 1..46: note = Hypo
  source 1..46: mol_type = genomic DNA

SEQ ID NO: 127634 - DNA, 30 bp, Homo sapiens; identical to SEQ ID NO: 97589
  misc_feature 1..30: note = chr7:41189426-41189456
  misc_feature 1..30: note = Hyper
  source 1..30: mol_type = genomic DNA

SEQ ID NO: 127635 - DNA, 193 bp, Homo sapiens; identical to SEQ ID NO: 97594
  misc_feature 1..193: note = chr7:41699313-41699506
  misc_feature 1..193: note = Hypo
  source 1..193: mol_type = genomic DNA

SEQ ID NO: 127636 - DNA, 89 bp, Homo sapiens; identical to SEQ ID NO: 97595
  misc_feature 1..89: note = chr7:41745163-41745252
  misc_feature 1..89: note = Hyper
  source 1..89: mol_type = genomic DNA

SEQ ID NO: 127637 - DNA, 96 bp, Homo sapiens; identical to SEQ ID NO: 97596
  misc_feature 1..96: note = chr7:41814070-41814166
  misc_feature 1..96: note = Hypo
  source 1..96: mol_type = genomic DNA

SEQ ID NO: 127638 - DNA, 30 bp, Homo sapiens; identical to SEQ ID NO: 97598
  misc_feature 1..30: note = chr7:41840845-41840875
  misc_feature 1..30: note = Hypo
  source 1..30: mol_type = genomic DNA

SEQ ID NO: 127639 - DNA, 43 bp, Homo sapiens; identical to SEQ ID NO: 97599
  misc_feature 1..43: note = chr7:41850638-41850681
  misc_feature 1..43: note = Hypo
  source 1..43: mol_type = genomic DNA

SEQ ID NO: 127640 - DNA, 30 bp, Homo sapiens; identical to SEQ ID NO: 41280
  misc_feature 1..30: note = chr7:41923780-41923810
  misc_feature 1..30: note = Hypo
  source 1..30: mol_type = genomic DNA

SEQ ID NO: 127641 - DNA, 30 bp, Homo sapiens; identical to SEQ ID NO: 41281
  misc_feature 1..30: note = chr7:41943672-41943702
  misc_feature 1..30: note = Hypo
  source 1..30: mol_type = genomic DNA

SEQ ID NO: 127642 - DNA, 17 bp, Homo sapiens
  misc_feature 1..17: note = chr7:41981795-41981812
  misc_feature 1..17: note = Hypo
  source 1..17: mol_type = genomic DNA
gggcgtggtggctcacg

SEQ ID NO: 127643 - DNA, 159 bp, Homo sapiens; identical to SEQ ID NO: 97605
  misc_feature 1..159: note = chr7:42005369-42005528
  misc_feature 1..159: note = Hypo
  source 1..159: mol_type = genomic DNA

SEQ ID NO: 127644 - DNA, 214 bp, Homo sapiens
  misc_feature 1..214: note = chr7:42267608-42267822
  misc_feature 1..214: note = Hyper
  source 1..214: mol_type = genomic DNA
aagggatgtttttcacgcctttcaccacttttgcccgcgcctgcgtcccctgcccgaggtcccaggccgcggcggcggcgcggtgggttcattagcgggcgcgccgggcccgcgcagcgctgtctgcagccgcgtcgccgcatccatcatcattacatcagcgcggggaagtccacgccgagttctcccggccccggcgcgccccagtcagcgc

SEQ ID NO: 127645 - DNA, 1287 bp, Homo sapiens; identical to SEQ ID NO: 97612
  misc_feature 1..1287: note = chr7:42275617-42276904
  misc_feature 1..1287: note = Hyper
  source 1..1287: mol_type = genomic DNA

SEQ ID NO: 127646 - DNA, 276 bp, Homo sapiens; identical to SEQ ID NO: 97613
  misc_feature 1..276: note = chr7:42277312-42277588
  misc_feature 1..276: note = Hyper
  source 1..276: mol_type = genomic DNA

SEQ ID NO: 127647 - DNA, 215 bp, Homo sapiens; identical to SEQ ID NO: 97614
  misc_feature 1..215: note = chr7:42277648-42277863
  misc_feature 1..215: note = Hyper
  source 1..215: mol_type = genomic DNA

SEQ ID NO: 127648 - DNA, 390 bp, Homo sapiens
  misc_feature 1..390: note = chr7:42533038-42533428
  misc_feature 1..390: note = Hyper
  source 1..390: mol_type = genomic DNA
gacagcaggagcagccggattttggaaagggaggaggccgggacgcatgcagcttggtgggggctgtgtccgaggtccgcagggagaagctgagcgacagccccagcagggacctactgctggcgcccactccccgcggccgctggccaagtgtgggctctcgggttcgtttccacccagcgcggcggtgttattcggagaaggaaaataaatgtctgcggttgctctgccgggctgcgggggcggtgccctggaaggaggggctgtgcatctgcaccatttctaggaatgtccgccctctgggaacccagccctgaagtgctctgagaatgagccgtgtttacggaaagcctctgtctcatgctccgcattctccgttctgattctgac

SEQ ID NO: 127649 - DNA, 26 bp, Homo sapiens
  misc_feature 1..26: note = chr7:42909823-42909849
  misc_feature 1..26: note = Hypo
  source 1..26: mol_type = genomic DNA
actgggagtaatggccgggcgcggtg

SEQ ID NO: 127650 - DNA, 385 bp, Homo sapiens; identical to SEQ ID NO: 97623
  misc_feature 1..385: note = chr7:42927790-42928175
  misc_feature 1..385: note = Hyper
  source 1..385: mol_type = genomic DNA

SEQ ID NO: 127651 - DNA, 1614 bp, Homo sapiens
  misc_feature 1..1614: note = chr7:43151970-43153584
  misc_feature 1..1614: note = Hyper
  source 1..1614: mol_type = genomic DNA
cacacacaaaagggccgaggagccagggttggtgttggatatgcccagtacgcgtgctgggtgttggaaggatggggccggcggtaacaagaatcgatatatatttaccgcgggggcgggggtgggggtgcgcggaggctgcagggcggggcagcgctaatgagagcaagcccggcttgtggttggttctggagtctggtacccacagaggagcaggcagggagggaggggatgcaagcgggaggataaagcgatgaagtgtgctgcgttaccgcgcatcaggcgctgttgttggagccggaacaccgtgcgactctgaccgaaccggccccctcctcgcgcacacactcgccgagccgcgcgcgcccctccgccgtgacagtggccgtggcctccgctctctcggggcacccggcagccagagcgcagcgagagcgggcggtcgccagggtcccctccccagccagtcccaggcgcccggtgcactatgcggggcacgtgcgccccccagctctaatctgcgcgctgacaggagcatgatctgtgcccaggccagggctgccaaggtaagcgggcgtagcgcggggacactgtctgccgccccttcccccccgcccttctctgggcggcttccccgccgcacgcgaggccccggcagcgccctcccttctcggggccgagatccaccctcctccccaccctctcgcttctcccgcgaggttcaattgtcagcctgggtcgcgccgccgcccggtccgggccggcatccccgggtggcgaccccggcttgggtactgcaggcgcacccggccctcctgcggggtacggagagaaacaaagaagcccccaagcgggttcgcagcgcctcccccgcccctcagcgccctcccagtggcgaggaggtgtcaggggagggggcggagagacctacgtaatcccccttcccagcccacacccaccccttgtgaaccaaagctctggatttgcgcttcgccttgggctcgcttttgaacaattgtgtcccatgcaatgcccgtggttagcccagagagcgcccagagcctccgcacgggctcgccggtgctcgctcgaggggcgcgtggccaggtccggcccttgctcccatggacgggtgcaggaggggaggaggcgctgtgtgggtgctcccccagcgcctccctgttaccggccggctgcgccgctcagccgggcctgccacctgagttttagcgggagcagtcatgtcgcctaccgtattgcgacttgcagacaggcagggagggagctgccggggcggggagggggggggaatgcgtccggtccatttttggctggaggtgcgcttcctgctacccccacgttcccgggcggtgacaatgcagcaaaatccgagggctcaaacaatgtggcccctccatccccggctccagggcattctgattgctctgccgctttgacgtcccggccacttggctgattttcagagccatgatgcgcggtgtctctgtcttgcacacagaggctgggcaccataacttcttccctgccgaatttcagcgcgtagggggagctggcagggacacaggctgcagagatgcccggcttcctgtggtt

SEQ ID NO: 127652 - DNA, 177 bp, Homo sapiens; identical to SEQ ID NO: 41284
  misc_feature 1..177: note = chr7:43237814-43237991
  misc_feature 1..177: note = Hypo
  source 1..177: mol_type = genomic DNA

SEQ ID NO: 127653 - DNA, 285 bp, Homo sapiens; identical to SEQ ID NO: 97632
  misc_feature 1..285: note = chr7:43279396-43279681
  misc_feature 1..285: note = Hypo
  source 1..285: mol_type = genomic DNA

SEQ ID NO: 127654 - DNA, 30 bp, Homo sapiens; identical to SEQ ID NO: 97633
  misc_feature 1..30: note = chr7:43282402-43282432
  misc_feature 1..30: note = Hypo
  source 1..30: mol_type = genomic DNA

SEQ ID NO: 127655 - DNA, 30 bp, Homo sapiens; identical to SEQ ID NO: 97634
  misc_feature 1..30: note = chr7:43304457-43304487
  misc_feature 1..30: note = Hypo
  source 1..30: mol_type = genomic DNA

SEQ ID NO: 127656 - DNA, 69 bp, Homo sapiens; identical to SEQ ID NO: 97635
  misc_feature 1..69: note = chr7:43351483-43351552
  misc_feature 1..69: note = Hypo
  source 1..69: mol_type = genomic DNA

SEQ ID NO: 127657 - DNA, 30 bp, Homo sapiens; identical to SEQ ID NO: 97638
  misc_feature 1..30: note = chr7:43656702-43656732
  misc_feature 1..30: note = Hypo
  source 1..30: mol_type = genomic DNA

SEQ ID NO: 127658 - DNA, 153 bp, Homo sapiens; identical to SEQ ID NO: 97639
  misc_feature 1..153: note = chr7:43767840-43767993
  misc_feature 1..153: note = Hypo
  source 1..153: mol_type = genomic DNA

SEQ ID NO: 127659 - DNA, 202 bp, Homo sapiens; identical to SEQ ID NO: 41286
  misc_feature 1..202: note = chr7:43865061-43865263
  misc_feature 1..202: note = Hypo
  source 1..202: mol_type = genomic DNA

SEQ ID NO: 127660 - DNA, 25 bp, Homo sapiens
  misc_feature 1..25: note = chr7:44083435-44083460
  misc_feature 1..25: note = Hypo
  source 1..25: mol_type = genomic DNA
ccaccgtgcccggcaggatttatat

SEQ ID NO: 127661 - DNA, 43 bp, Homo sapiens; identical to SEQ ID NO: 97642
  misc_feature 1..43: note = chr7:44097753-44097796
  misc_feature 1..43: note = Hypo
  source 1..43: mol_type = genomic DNA

SEQ ID NO: 127662 - DNA, 633 bp, Homo sapiens
  misc_feature 1..633: note = chr7:44143891-44144524
  misc_feature 1..633: note = Hyper
  source 1..633: mol_type = genomic DNA
ccgggggtggggagccggctccggaagccccggcgcccccgccccgggccccgccagcgctttggagacggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaaggtaagag

SEQ ID NO: 127663 - DNA, 41 bp, Homo sapiens; identical to SEQ ID NO: 97645
  misc_feature 1..41: note = chr7:44149886-44149927
  misc_feature 1..41: note = Hypo
  source 1..41: mol_type = genomic DNA

SEQ ID NO: 127664 - DNA, 71 bp, Homo sapiens; identical to SEQ ID NO: 97646
  misc_feature 1..71: note = chr7:44151000-44151071
  misc_feature 1..71: note = Hypo
  source 1..71: mol_type = genomic DNA

SEQ ID NO: 127665 - DNA, 501 bp, Homo sapiens; identical to SEQ ID NO: 97647
  misc_feature 1..501: note = chr7:44151276-44151777
  misc_feature 1..501: note = Hypo
  source 1..501: mol_type = genomic DNA

SEQ ID NO: 127666 - DNA, 96 bp, Homo sapiens; identical to SEQ ID NO: 97648
  misc_feature 1..96: note = chr7:44152156-44152252
  misc_feature 1..96: note = Hypo
  source 1..96: mol_type = genomic DNA

SEQ ID NO: 127667 - DNA, 194 bp, Homo sapiens; identical to SEQ ID NO: 97649
  misc_feature 1..194: note = chr7:44153428-44153622
  misc_feature 1..194: note = Hypo
  source 1..194: mol_type = genomic DNA

SEQ ID NO: 127668 - DNA, 35 bp, Homo sapiens; identical to SEQ ID NO: 97650
  misc_feature 1..35: note = chr7:44164101-44164136
  misc_feature 1..35: note = Hypo
  source 1..35: mol_type = genomic DNA

SEQ ID NO: 127669 - DNA, 30 bp, Homo sapiens; identical to SEQ ID NO: 41290
  misc_feature 1..30: note = chr7:44193301-44193331
  misc_feature 1..30: note = Hypo
  source 1..30: mol_type = genomic DNA

SEQ ID NO: 127670 - DNA, 189 bp, Homo sapiens; identical to SEQ ID NO: 97652
  misc_feature 1..189: note = chr7:44258465-44258654
  misc_feature 1..189: note = Hypo
  source 1..189: mol_type = genomic DNA

SEQ ID NO: 127671 - DNA, 53 bp, Homo sapiens; identical to SEQ ID NO: 41292
  misc_feature 1..53: note = chr7:44259286-44259339
  misc_feature 1..53: note = Hypo
  source 1..53: mol_type = genomic DNA

SEQ ID NO: 127672 - DNA, 30 bp, Homo sapiens; identical to SEQ ID NO: 41293
  misc_feature 1..30: note = chr7:44275594-44275624
  misc_feature 1..30: note = Hypo
  source 1..30: mol_type = genomic DNA

SEQ ID NO: 127673 - DNA, 30 bp, Homo sapiens; identical to SEQ ID NO: 97655
  misc_feature 1..30: note = chr7:44279543-44279573
  misc_feature 1..30: note = Hypo
  source 1..30: mol_type = genomic DNA

SEQ ID NO: 127674 - DNA, 30 bp, Homo sapiens; identical to SEQ ID NO: 97656
  misc_feature 1..30: note = chr7:44298773-44298803
  misc_feature 1..30: note = Hypo
  source 1..30: mol_type = genomic DNA

SEQ ID NO: 127675 - DNA, 205 bp, Homo sapiens; identical to SEQ ID NO: 97657
  misc_feature 1..205: note = chr7:44304621-44304826
  misc_feature 1..205: note = Hypo
  source 1..205: mol_type = genomic DNA

SEQ ID NO: 127676 - DNA, 30 bp, Homo sapiens; identical to SEQ ID NO: 97658
  misc_feature 1..30: note = chr7:44307247-44307277
  misc_feature 1..30: note = Hypo
  source 1..30: mol_type = genomic DNA

SEQ ID NO: 127677 - DNA, 47 bp, Homo sapiens; identical to SEQ ID NO: 97659
  misc_feature 1..47: note = chr7:44307677-44307724
  misc_feature 1..47: note = Hypo
  source 1..47: mol_type = genomic DNA

SEQ ID NO: 127678 - DNA, 170 bp, Homo sapiens
  misc_feature 1..170: note = chr7:44349559-44349729
  misc_feature 1..170: note = Hyper
  source 1..170: mol_type = genomic DNA
ctcgcgaaggacacgcgggaagagcctttccgccggctgagccgtgggcgccaccgccagggaccccaggctcaccaagccacgcgcggaaccgcacggtggccgagaccgggcgggggcgggggcgctttgggagttaggatacgctttgtgcccgcttgctgcttttt

SEQ ID NO: 127679 - DNA, 773 bp, Homo sapiens
  misc_feature 1..773: note = chr7:44364485-44365258
  misc_feature 1..773: note = Hyper
  source 1..773: mol_type = genomic DNA
tcccgccacccccgccgcctgccgctcgggtgggggtggggacagcgcacccgcgtcggggacgaccctctggggccgcagccgacccctcccggcgctccaggcccgggggccacccccgcgcgcccctcctctctgacctccccgccgccaaatgcgtcacgtctgccgggcgctccggggacacctgctgccgcccccgccgcgccaagtcgcgagcccggagccccggcccggcagccgcgctgggcagagctgggcagggccgcgcgcgctgaggtcaggcagccaggcccggggccgggggctcgcgggtcggggccgcgcggggccgtgcgcttgggcccggagcccagagaagccggcggcgcgcgggcccgcagtgcgcctggagccggcggcgcggagggtcccggaggtcccggccctctggggtccccggcccagcccgcgcgcgccgctgctcttacttgccaatatcctcgtagagctggtactcgtcggtgaagcgggtgcaggtcaccgtggtggccatggcggcggcggacgggctcggcgtgcgctcggctgcgctcgggcggcggcgactccggctcccgctcgcgggcacggcggcgacacgggcgcgggcgcgggagacacctcggctcgcggcgccaggcgggggccgggctgggctgcgccgggcggcgagcgcacgcgagatctgctcgctccgtcctcgccaggagcgcgccgcacacctacgcgcggggaggcgcgggcgccgctgt

SEQ ID NO: 127680 - DNA, 40 bp, Homo sapiens; identical to SEQ ID NO: 97665
  misc_feature 1..40: note = chr7:44430994-44431034
  misc_feature 1..40: note = Hypo
  source 1..40: mol_type = genomic DNA

SEQ ID NO: 127681 - DNA, 37 bp, Homo sapiens; identical to SEQ ID NO: 97666
  misc_feature 1..37: note = chr7:44517855-44517892
  misc_feature 1..37: note = Hypo
  source 1..37: mol_type = genomic DNA

SEQ ID NO: 127682 - DNA, 59 bp, Homo sapiens; identical to SEQ ID NO: 97667
  misc_feature 1..59: note = chr7:44582470-44582529
  misc_feature 1..59: note = Hypo
  source 1..59: mol_type = genomic DNA

SEQ ID NO: 127683 - DNA, 30 bp, Homo sapiens; identical to SEQ ID NO: 41296
  misc_feature 1..30: note = chr7:44717883-44717913
  misc_feature 1..30: note = Hypo
  source 1..30: mol_type = genomic DNA

SEQ ID NO: 127684 - DNA, 30 bp, Homo sapiens; identical to SEQ ID NO: 97670
  misc_feature 1..30: note = chr7:44746915-44746945
  misc_feature 1..30: note = Hypo
  source 1..30: mol_type = genomic DNA

SEQ ID NO: 127685 - DNA, 30 bp, Homo sapiens; identical to SEQ ID NO: 97671
  misc_feature 1..30: note = chr7:44796802-44796832
  misc_feature 1..30: note = Hypo
  source 1..30: mol_type = genomic DNA

SEQ ID NO: 127686 - DNA, 30 bp, Homo sapiens; identical to SEQ ID NO: 41297
  misc_feature 1..30: note = chr7:44801185-44801215
  misc_feature 1..30: note = Hypo
  source 1..30: mol_type = genomic DNA

SEQ ID NO: 127687 - DNA, 277 bp, Homo sapiens; identical to SEQ ID NO: 97674
  misc_feature 1..277: note = chr7:44835107-44835384
  misc_feature 1..277: note = Hypo
  source 1..277: mol_type = genomic DNA

SEQ ID NO: 127688 - DNA, 42 bp, Homo sapiens; identical to SEQ ID NO: 97675
  misc_feature 1..42: note = chr7:44896731-44896773
  misc_feature 1..42: note = Hyper
  source 1..42: mol_type = genomic DNA

SEQ ID NO: 127689 - DNA, 216 bp, Homo sapiens; identical to SEQ ID NO: 97676
  misc_feature 1..216: note = chr7:44924253-44924469
  misc_feature 1..216: note = Hyper
  source 1..216: mol_type = genomic DNA

SEQ ID NO: 127690 - DNA, 40 bp, Homo sapiens; identical to SEQ ID NO: 97677
  misc_feature 1..40: note = chr7:44967575-44967615
  misc_feature 1..40: note = Hypo
  source 1..40: mol_type = genomic DNA

SEQ ID NO: 127691 - DNA, 30 bp, Homo sapiens; identical to SEQ ID NO: 97678
  misc_feature 1..30: note = chr7:45005732-45005762
  misc_feature 1..30: note = Hypo
  source 1..30: mol_type = genomic DNA

SEQ ID NO: 127692 - DNA, 27 bp, Homo sapiens
  misc_feature 1..27: note = chr7:45027184-45027211
  misc_feature 1..27: note = Hypo
  source 1..27: mol_type = genomic DNA
attgttaagggacgaaagggccaagag

SEQ ID NO: 127693 - DNA, 34 bp, Homo sapiens; identical to SEQ ID NO: 97680
  misc_feature 1..34: note = chr7:45038532-45038566
  misc_feature 1..34: note = Hypo
  source 1..34: mol_type = genomic DNA

SEQ ID NO: 127694 - DNA, 34 bp, Homo sapiens; identical to SEQ ID NO: 41301
  misc_feature 1..34: note = chr7:45125675-45125709
  misc_feature 1..34: note = Hypo
  source 1..34: mol_type = genomic DNA

SEQ ID NO: 127695 - DNA, 680 bp, Homo sapiens; identical to SEQ ID NO: 97683
  misc_feature 1..680: note = chr7:45128453-45129133
  misc_feature 1..680: note = Hyper
  source 1..680: mol_type = genomic DNA

SEQ ID NO: 127696 - DNA, 37 bp, Homo sapiens; identical to SEQ ID NO: 97684
  misc_feature 1..37: note = chr7:45197017-45197054
  misc_feature 1..37: note = Hyper
  source 1..37: mol_type = genomic DNA

SEQ ID NO: 127697 - DNA, 214 bp, Homo sapiens; identical to SEQ ID NO: 97685
  misc_feature 1..214: note = chr7:45197376-45197590
  misc_feature 1..214: note = Hyper
  source 1..214: mol_type = genomic DNA

SEQ ID NO: 127698 - DNA, 108 bp, Homo sapiens; identical to SEQ ID NO: 97686
  misc_feature 1..108: note = chr7:45222863-45222971
  misc_feature 1..108: note = Hypo
  source 1..108: mol_type = genomic DNA

SEQ ID NO: 127699 - DNA, 45 bp, Homo sapiens; identical to SEQ ID NO: 97687
  misc_feature 1..45: note = chr7:45293665-45293710
  misc_feature 1..45: note = Hypo
  source 1..45: mol_type = genomic DNA

SEQ ID NO: 127700 - DNA, 1537 bp, Homo sapiens
  misc_feature 1..1537: note = chr7:45613422-45614959
  misc_feature 1..1537: note = Hyper
  source 1..1537: mol_type = genomic DNA
cgcccacagggtctccgcgaccctagagcttagggaagaattgccgaggggcggggggtccctcatgcgcatggaagggacgtacgccccaggcctccaccttcctcctgaccccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaaggaaggtactcgaggtcacgcggctcctccggcgggcgggaacgcaggacgcggagttggggcgcgggctgtgcgcgcccaggttcgcggctcccggggctcggctgtcgcagcgcggtcgccgccgaggaccacggtcggggcgcgggcgggctccagtgcgcaggcgcggcgggcgggaggggacgcgctccgggcgcgcgcgcggggcagccggcgccccaactccgcccgccccgcgccccgcgccccggcgcctcgccgcccgccgcccgcccgccccggcgccgccgcccgcgccccggcgccccgggccggcgaggggcgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacggtaagtgcagccgcgcacccctcatctggtctcggacacacttgctgggacgatgctgggaatgcccggagtcgggcgcgctttttcctatgcggcgggtggggacactgaggctccgagtgggggtgtgttcaaggtcactcctacgagttggggacgcagtcggggctggcaccct

SEQ ID NO: 127701 - DNA, 30 bp, Homo sapiens; identical to SEQ ID NO: 97691
  misc_feature 1..30: note = chr7:45615610-45615640
  misc_feature 1..30: note = Hyper
  source 1..30: mol_type = genomic DNA

SEQ ID NO: 127702 - DNA, 30 bp, Homo sapiens; identical to SEQ ID NO: 97692
  misc_feature 1..30: note = chr7:45717349-45717379
  misc_feature 1..30: note = Hypo
  source 1..30: mol_type = genomic DNA

SEQ ID NO: 127703 - DNA, 30 bp, Homo sapiens; identical to SEQ ID NO: 97693
  misc_feature 1..30: note = chr7:45807201-45807231
  misc_feature 1..30: note = Hypo
  source 1..30: mol_type = genomic DNA

SEQ ID NO: 127704 - DNA, 30 bp, Homo sapiens; identical to SEQ ID NO: 97694
  misc_feature 1..30: note = chr7:45807471-45807501
  misc_feature 1..30: note = Hypo
  source 1..30: mol_type = genomic DNA

SEQ ID NO: 127705 - DNA, 33 bp, Homo sapiens; identical to SEQ ID NO: 97695
  misc_feature 1..33: note = chr7:45928114-45928147
  misc_feature 1..33: note = Hyper
  source 1..33: mol_type = genomic DNA

SEQ ID NO: 127706 - DNA, 243 bp, Homo sapiens; identical to SEQ ID NO: 97696
  misc_feature 1..243: note = chr7:45928349-45928592
  misc_feature 1..243: note = Hyper
  source 1..243: mol_type = genomic DNA

SEQ ID NO: 127707 - DNA, 1583 bp, Homo sapiens; identical to SEQ ID NO: 97697
  misc_feature 1..1583: note = chr7:45959968-45961551
  misc_feature 1..1583: note = Hyper
  source 1..1583: mol_type = genomic DNA

SEQ ID NO: 127708 - DNA, 218 bp, Homo sapiens; identical to SEQ ID NO: 97698
  misc_feature 1..218: note = chr7:45961756-45961974
  misc_feature 1..218: note = Hyper
  source 1..218: mol_type = genomic DNA

SEQ ID NO: 127709 - DNA, 241 bp, Homo sapiens; identical to SEQ ID NO: 97702
  misc_feature 1..241: note = chr7:47394691-47394932
  misc_feature 1..241: note = Hypo
  source 1..241: mol_type = genomic DNA

SEQ ID NO: 127710 - DNA, 45 bp, Homo sapiens; identical to SEQ ID NO: 97703
  misc_feature 1..45: note = chr7:47409164-47409209
  misc_feature 1..45: note = Hypo
  source 1..45: mol_type = genomic DNA

SEQ ID NO: 127711 - DNA, 203 bp, Homo sapiens; identical to SEQ ID NO: 41306
  misc_feature 1..203: note = chr7:47420119-47420322
  misc_feature 1..203: note = Hypo
  source 1..203: mol_type = genomic DNA

SEQ ID NO: 127712 - DNA, 142 bp, Homo sapiens; identical to SEQ ID NO: 41307
  misc_feature 1..142: note = chr7:47420382-47420524
  misc_feature 1..142: note = Hypo
  source 1..142: mol_type = genomic DNA

SEQ ID NO: 127713 - DNA, 30 bp, Homo sapiens; identical to SEQ ID NO: 97706
  misc_feature 1..30: note = chr7:47446763-47446793
  misc_feature 1..30: note = Hypo
  source 1..30: mol_type = genomic DNA

SEQ ID NO: 127714 - DNA, 30 bp, Homo sapiens; identical to SEQ ID NO: 41308
  misc_feature 1..30: note = chr7:47449194-47449224
  misc_feature 1..30: note = Hypo
  source 1..30: mol_type = genomic DNA

SEQ ID NO: 127715 - DNA, 121 bp, Homo sapiens; identical to SEQ ID NO: 97708
  misc_feature 1..121: note = chr7:47513123-47513244
  misc_feature 1..121: note = Hypo
  source 1..121: mol_type = genomic DNA

SEQ ID NO: 127716 - DNA, 30 bp, Homo sapiens; identical to SEQ ID NO: 97710
  misc_feature 1..30: note = chr7:47515683-47515713
  misc_feature 1..30: note = Hypo
  source 1..30: mol_type = genomic DNA

SEQ ID NO: 127717 - DNA, 61 bp, Homo sapiens; identical to SEQ ID NO: 41309
  misc_feature 1..61: note = chr7:47586473-47586534
  misc_feature 1..61: note = Hypo
  source 1..61: mol_type = genomic DNA

SEQ ID NO: 127718 - DNA, 30 bp, Homo sapiens; identical to SEQ ID NO: 41310
  misc_feature 1..30: note = chr7:47702782-47702812
  misc_feature 1..30: note = Hypo
  source 1..30: mol_type = genomic DNA

SEQ ID NO: 127719 - DNA, 1012 bp, Homo sapiens; identical to SEQ ID NO: 97721
  misc_feature 1..1012: note = chr7:48074892-48075904
  misc_feature 1..1012: note = Hyper
  source 1..1012: mol_type = genomic DNA

SEQ ID NO: 127720 - DNA, 18 bp, Homo sapiens
  misc_feature 1..18: note = chr7:48465341-48465359
  misc_feature 1..18: note = Hypo
  source 1..18: mol_type = genomic DNA
atttatttattttttcga

SEQ ID NO: 127721 - DNA, 20 bp, Homo sapiens
  misc_feature 1..20: note = chr7:49493501-49493521
  misc_feature 1..20: note = Hypo
  source 1..20: mol_type = genomic DNA
cagcccgccatgcctgagcc

SEQ ID NO: 127722 - DNA, 203 bp, Homo sapiens; identical to SEQ ID NO: 97749
  misc_feature 1..203: note = chr7:49700763-49700966
  misc_feature 1..203: note = Hypo
  source 1..203: mol_type = genomic DNA

SEQ ID NO: 127723 - DNA, 179 bp, Homo sapiens; identical to SEQ ID NO: 97750
  misc_feature 1..179: note = chr7:49740612-49740791
  misc_feature 1..179: note = Hypo
  source 1..179: mol_type = genomic DNA

SEQ ID NO: 127724 - DNA, 3074 bp, Homo sapiens
  misc_feature 1..3074: note = chr7:49812691-49815765
  misc_feature 1..3074: note = Hyper
  source 1..3074: mol_type = genomic DNA
agaggaagatgggagcggggagagattggcagagattcagaaagttcgcgcttgagatttttacgtttcttactcgtaaacgtctatttctctgggtttctgaatgcaaagacgagaaagtctcaacagtctgctaaactaacacggccttcgaatcccaatctgaacacagtagctgaaacaagctgtccacaaagaggaaagccagagggggccaattaggaaggaagaaattaaagaaaagagaaaagccaagatgaaaggtccagcgcaaagtgaatgactcgactggagaatggcagccctggcagggtctgcggccggctgcggaggtggggacgcggccgcgcggacgagtgacaggttggtccggcgcagcaaagggagcgggtgcggcggtagggcctctccgggggcagcgcgagggcctcccccggggcagcgcgggccaaggcggggcctccagagcgggggcagcagaggagggagcggaacgggagccgggcggaggcggctgcggcagggggaggcgggaggcgggcgcgctagctcccatgctggcctcggtgccactcgcgcgccggccgcgctccgggcttctcttttccctccgacgcgccacggctgcccagacattccggctgccgggtctggagagctccccgaacccctccgcggagaggagcgaggcggcgccagggtggcccccggggcgcgcttggtctcggagaagcggggacgaggccggaggatgagcgactgagggcgacgcgggcactgacgcgagttggggccgcgactaccggcagctgacagcgcgatgagcgactccccagagacgccctagcccggtgtgcgcgccaggcggagcgcgcaggtggggctgggctgttagtggtccgccccacgcgggtcgccggccggcccaggatgggcgctggcaacccgggcccgcgcccgccgctgctacccctgcgcccgctgcgagcccggcgtccggcccgcgccctgcgctcatgtatgtaggtttggcgccggtcttcagggctgagggtgcatgctgggtgtccccgcgcggccggacgcgctccagctgggttcagccgctcagctgctccggaggaaccccctcccccgcccaagtttgtgaatatgggcgcttcgcccagtgttgaggtcggcagggaccgggcagggggtcagcagggccgggcacgtccggagccctcagggaggagggctgagggggaggggacagacgcaccggagtgcgcagagtgggggcgttcggggagtgaggcggagagaggctggattgccggtgtcctgcggcgtctcgggctctcccagcccctttgggcggcagaaactttggaatccagaaaggctggccgggatccagcgagtaggagggtctcgcgcccactctgcgccctggggccccagcctcccgcactgcacaccttggtgctgcccgggcgcttctgctccgcagccaggacactacaagactgagcgctgcggccggcgacctggctcccaaggctcggaggggcgggccggcagaggagctgaagccccgggaatccccgacccggccctctggcaaggggccgagggcatcctttcatgcagcggggcttagagagcggggagggggcgtctgctcccgagacgggagtcttttaagaagttgttagaaatgaatcgtggagtcctaggagaagctttgtttaacctccccgcattttcccagcacaaccccctaaagcaaatgaggaagagtttccctcttatcttcctgtacattcgtccgtctctaactccactgctgaattctccatttaataaccttcgggaaatgtggccaggacctagggagggacaccctgggtgcctgaattacgtggttcaaggcagagctttgcaggggggcgcgggcctggctcgctgcgttccctgggctccgcaagccgcccttggccatctccaacactaatcacgactacatcagaaacacgccggccggtgtcgttcttggatttcgcttccaatgtatcgctccacagtttgtgatgtctaagaaccccggccgtgcaccgacgctgggcatgctgcccccgcccccgtcgcccagctcgttaatctagagctatgccggagcccgggtgggggccgcggcgggccggggcgcgcgcgggccgcggggctcagttgtgctgctgttctctccgcagggacggcggctcccggctggcggcggcgcgcccccgggctgtgaatgcgactcgcccctcggccgcgctccccgcccgcccgcccgccgggacgtggtaggggatgcccagctccactgcgatggcagttggcgcgctctccagttccctcctggtcacctgctgcctgatggtggctctgtgcagtccgagcatcccgctggagaagctggcccaggcaccagagcagccgggccaggagaagcgtgagcacgcctctcgggacggcccggggcgggtgaacgagctcgggcgcccggcgagggacgagggcggcagcggccgggactggaagagcaagagcggccgtgggctcgccggccgtgagccgtggagcaagctgaagcaggcctgggtctcccagggcgggggcgccaaggccggggatctgcaggtccggccccgcggggacaccccgcaggcggaagccctggccgcagccgcccaggacgcgattggcccggaactcgcgcccacgcccgagccacccgaggagtacgtgtacccggactaccgtggcaagggctgcgtggacgagagcggcttcgtgtacgcgatcggggagaagttcgcgccgggcccctcggcctgcccgtgcctgtgcaccgaggaggggccgctgtgcgcgcagcccgagtgcccgaggctgcacccgcgctgcatccacgtcgacacgagccagtgctgcccgcagtgcaaggagaggaagaactactgcgagttccggggcaagacctatcagactttggaggagttcgtggtaagatgcgaacgcccgccgggcgactttgcaccttc

SEQ ID NO: 127725 - DNA, 30 bp, Homo sapiens; identical to SEQ ID NO: 97760
  misc_feature 1..30: note = chr7:50140443-50140473
  misc_feature 1..30: note = Hypo
  source 1..30: mol_type = genomic DNA

SEQ ID NO: 127726 - DNA, 20 bp, Homo sapiens
  misc_feature 1..20: note = chr7:50141622-50141642
  misc_feature 1..20: note = Hypo
  source 1..20: mol_type = genomic DNA
aatgccaaaatttgccgggc

SEQ ID NO: 127727 - DNA, 37 bp, Homo sapiens; identical to SEQ ID NO: 97762
  misc_feature 1..37: note = chr7:50207925-50207962
  misc_feature 1..37: note = Hypo
  source 1..37: mol_type = genomic DNA

SEQ ID NO: 127728 - DNA, 80 bp, Homo sapiens; identical to SEQ ID NO: 97764
  misc_feature 1..80: note = chr7:50231283-50231363
  misc_feature 1..80: note = Hypo
  source 1..80: mol_type = genomic DNA

SEQ ID NO: 127729 - DNA, 30 bp, Homo sapiens; identical to SEQ ID NO: 41313
  misc_feature 1..30: note = chr7:50241354-50241384
  misc_feature 1..30: note = Hypo
  source 1..30: mol_type = genomic DNA

SEQ ID NO: 127730 - DNA, 206 bp, Homo sapiens; identical to SEQ ID NO: 97766
  misc_feature 1..206: note = chr7:50243557-50243763
  misc_feature 1..206: note = Hypo
  source 1..206: mol_type = genomic DNA

SEQ ID NO: 127731 - DNA, 255 bp, Homo sapiens; identical to SEQ ID NO: 97767
  misc_feature 1..255: note = chr7:50251373-50251628
  misc_feature 1..255: note = Hypo
  source 1..255: mol_type = genomic DNA

SEQ ID NO: 127732 - DNA, 262 bp, Homo sapiens; identical to SEQ ID NO: 97769
  misc_feature 1..262: note = chr7:50293897-50294159
  misc_feature 1..262: note = Hypo
  source 1..262: mol_type = genomic DNA

SEQ ID NO: 127733 - DNA, 22 bp, Homo sapiens
  misc_feature 1..22: note = chr7:50294459-50294481
  misc_feature 1..22: note = Hypo
  source 1..22: mol_type = genomic DNA
catgaatcggtattcaattgta

SEQ ID NO: 127734 - DNA, 30 bp, Homo sapiens; identical to SEQ ID NO: 41317
  misc_feature 1..30: note = chr7:50337681-50337711
  misc_feature 1..30: note = Hypo
  source 1..30: mol_type = genomic DNA

SEQ ID NO: 127735 - DNA, 30 bp, Homo sapiens; identical to SEQ ID NO: 97772
  misc_feature 1..30: note = chr7:50342284-50342314
  misc_feature 1..30: note = Hypo
  source 1..30: mol_type = genomic DNA

SEQ ID NO: 127736 - DNA, 1530 bp, Homo sapiens
  misc_feature 1..1530: note = chr7:50343208-50344738
  misc_feature 1..1530: note = Hyper
  source 1..1530: mol_type = genomic DNA
cctcgggtgggcactcgcatcctggggccggagcctgaacccgggagccaaggggccccagttccagggacgtgaagctgagcgtacagcgggcgctcccagacactggggaaagtgctttacgatgtcccgagtccctccagtctcgccagcggggcgagcgtgagggtgccccgaccgaccagcggccccgggtgcagggtggcgggcccggcggcgcgcgtccccctccccctcctggcggcccgcacgtgtcgcccgcgccgcgcccccacgggttacgcgcgggtcccgcagcgccgcggccgagccgggctgcccggcccgcggacacagcgccggccgccgcatcccgtgcggggccgcggcgcgatgctgcgctggaatgaggaagcgcggcggcgaggggagggcccgggcgcggtgcgcgcgggggtggcggcggcgcgccgagcgggcccggcgcgggcgagcgggctgcagccggcggcggcgccagcaggtacggcccgcacccgccgccgccccggcggcctttgggggctgagccggagcccggcgcgattgcaaagttttcgtgcgcggcccctctggcccggagttgcggctgagacgcgcgccgcgcgagccgggggactcggcgacggggcggggacgggacgacgcaccctctccgtgtcccgctctgcgcccttctgcgcgccccgctccctgtaccggagcagcgatccgggaggcggccgagaggtgcgcgcggggccgagccggctgcggggcaggtcgagcagggaccgccagcgtgcgtcaccccaaagtttgcggggtggcagggcgcgcgctctggccacccgccgctctgggcggcagctggtggcaacgcaagggcgcggcgggggcggccggcgcggagggggccaggtacggggcccgcgggcggcgctgtgcgcgcggggcagccggtcggccgggagcgcgaaagcctggtctgagccggctgggggcggggagtgtggcggagaaatggggaacaatgcgagtgagcaacttcaggaagtcattgtgaaagaaagctgggaagagctccgcggccaagttagcaggacactctaacaagtgactgcgcggcccgcgcccggggcggtgactgcggcaagccccctgggtccccgcgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacgtgagtgttttcaaattgaatttcaataggaaaacttggggtaactggtgaatttaaaaaaaaaaaaacacagtaaagaaaagcggtaaggttggtagaccctggtgtcgctcaggtccgcctctcttttctgaggacagtgagagagttcacttctgtcaagcgtctgttgctctgcactgtgccagcaggtgcaggaccaggccgacatgggacactt

SEQ ID NO: 127737 - DNA, 42 bp, Homo sapiens; identical to SEQ ID NO: 97777
  misc_feature 1..42: note = chr7:50365027-50365069
  misc_feature 1..42: note = Hypo
  source 1..42: mol_type = genomic DNA

SEQ ID NO: 127738 - DNA, 34 bp, Homo sapiens; identical to SEQ ID NO: 97779
  misc_feature 1..34: note = chr7:50423090-50423124
  misc_feature 1..34: note = Hypo
  source 1..34: mol_type = genomic DNA

SEQ ID NO: 127739 - DNA, 166 bp, Homo sapiens; identical to SEQ ID NO: 41320
  misc_feature 1..166: note = chr7:50438618-50438784
  misc_feature 1..166: note = Hypo
  source 1..166: mol_type = genomic DNA

SEQ ID NO: 127740 - DNA, 156 bp, Homo sapiens; identical to SEQ ID NO: 97781
  misc_feature 1..156: note = chr7:50444259-50444415
  misc_feature 1..156: note = Hypo
  source 1..156: mol_type = genomic DNA

SEQ ID NO: 127741 - DNA, 30 bp, Homo sapiens; identical to SEQ ID NO: 97782
  misc_feature 1..30: note = chr7:50454697-50454727
  misc_feature 1..30: note = Hypo
  source 1..30: mol_type = genomic DNA

SEQ ID NO: 127742 - DNA, 30 bp, Homo sapiens; identical to SEQ ID NO: 41322
  misc_feature 1..30: note = chr7:50471189-50471219
  misc_feature 1..30: note = Hypo
  source 1..30: mol_type = genomic DNA

SEQ ID NO: 127743 - DNA, 106 bp, Homo sapiens; identical to SEQ ID NO: 41323
  misc_feature 1..106: note = chr7:50560557-50560663
  misc_feature 1..106: note = Hypo
  source 1..106: mol_type = genomic DNA

SEQ ID NO: 127744 - DNA, 30 bp, Homo sapiens; identical to SEQ ID NO: 97785
  misc_feature 1..30: note = chr7:50561907-50561937
  misc_feature 1..30: note = Hypo
  source 1..30: mol_type = genomic DNA

SEQ ID NO: 127745 - DNA, 99 bp, Homo sapiens; identical to SEQ ID NO: 97787
  misc_feature 1..99: note = chr7:50860193-50860292
  misc_feature 1..99: note = Hyper
  source 1..99: mol_type = genomic DNA

SEQ ID NO: 127746 - DNA, 45 bp, Homo sapiens
  misc_feature 1..45: note = chr7:50861076-50861121
  misc_feature 1..45: note = Hyper
  source 1..45: mol_type = genomic DNA
aactttgggctccaccgggtctccgagcgccgagcccgcccggcc

SEQ ID NO: 127747 - DNA, 196 bp, Homo sapiens; identical to SEQ ID NO: 97789
  misc_feature 1..196: note = chr7:50861335-50861531
  misc_feature 1..196: note = Hyper
  source 1..196: mol_type = genomic DNA

SEQ ID NO: 127748 - DNA, 62 bp, Homo sapiens; identical to SEQ ID NO: 97791
  misc_feature 1..62: note = chr7:51383330-51383392
  misc_feature 1..62: note = Hyper
  source 1..62: mol_type = genomic DNA

SEQ ID NO: 127749 - DNA, 669 bp, Homo sapiens; identical to SEQ ID NO: 97792
  misc_feature 1..669: note = chr7:51384251-51384920
  misc_feature 1..669: note = Hyper
  source 1..669: mol_type = genomic DNA

SEQ ID NO: 127750 - DNA, 105 bp, Homo sapiens; identical to SEQ ID NO: 97793
  misc_feature 1..105: note = chr7:51408343-51408448
  misc_feature 1..105: note = Hypo
  source 1..105: mol_type = genomic DNA

SEQ ID NO: 127751 - DNA, 30 bp, Homo sapiens; identical to SEQ ID NO: 97795
  misc_feature 1..30: note = chr7:51873296-51873326
  misc_feature 1..30: note = Hypo
  source 1..30: mol_type = genomic DNA

SEQ ID NO: 127752 - DNA, 69 bp, Homo sapiens; identical to SEQ ID NO: 97796
  misc_feature 1..69: note = chr7:51886447-51886516
  misc_feature 1..69: note = Hypo
  source 1..69: mol_type = genomic DNA

SEQ ID NO: 127753 - DNA, 28 bp, Homo sapiens
  misc_feature 1..28: note = chr7:52268621-52268649
  misc_feature 1..28: note = Hypo
  source 1..28: mol_type = genomic DNA
ttttgtttgtttgttcgtttgtttgttt

SEQ ID NO: 127754 - DNA, 30 bp, Homo sapiens; identical to SEQ ID NO: 41325
  misc_feature 1..30: note = chr7:52499272-52499302
  misc_feature 1..30: note = Hypo
  source 1..30: mol_type = genomic DNA

SEQ ID NO: 127755 - DNA, 61 bp, Homo sapiens; identical to SEQ ID NO: 97800
  misc_feature 1..61: note = chr7:52736850-52736911
  misc_feature 1..61: note = Hypo
  source 1..61: mol_type = genomic DNA

SEQ ID NO: 127756 - DNA, 30 bp, Homo sapiens; identical to SEQ ID NO: 97802
  misc_feature 1..30: note = chr7:53103556-53103586
  misc_feature 1..30: note = Hypo
  source 1..30: mol_type = genomic DNA

SEQ ID NO: 127757 - DNA, 60 bp, Homo sapiens; identical to SEQ ID NO: 97803
  misc_feature 1..60: note = chr7:53104173-53104233
  misc_feature 1..60: note = Hypo
  source 1..60: mol_type = genomic DNA

SEQ ID NO: 127758 - DNA, 105 bp, Homo sapiens; identical to SEQ ID NO: 97810
  misc_feature 1..105: note = chr7:53364374-53364479
  misc_feature 1..105: note = Hypo
  source 1..105: mol_type = genomic DNA

SEQ ID NO: 127759 - DNA, 755 bp, Homo sapiens
  misc_feature 1..755: note = chr7:54609581-54610336
  misc_feature 1..755: note = Hyper
  source 1..755: mol_type = genomic DNA
aaattcgtgtgaaatcgtagcatgtgatgctcctggttggagcagttaataactgggtaagcggcatttccctaaatggctgttttcctcggcccacccgtctctcccccatcccattgctccccggtcctcagcaatgccccaactccctcccggaaccttttgctccgagccccccgccagcgccgcaatcccgtcactgtattgtcctcctcggcaccgagcgatctgatccgccgagccagaaagacacccgatgggggagagaagcaaagtggaaaaaaaccgacgtccctgctctccagaagggagaccccagcggcgccgacgagccctgcgccctccgcggccgcccggcgcgagctcccgggcggggcgctgtccagcgcgcacagagttaaaggcatcatcgcagccattagagggaaaagttgcggcgccgcgagcccggcgaagtcctcagcccgccccgcttgcccactccccacttcccgagccggctccgtgtttagggagggcagtgatcacgcaagccggagcggcgggctgacgttggacgagctgccaggtagctgaaagcaggcagccaggcagccgagacacttcccagcgattccagcctgggctccgcaggaagcctcgctgaatcccagccagctggttctaaccttccagaatcgcaatcccttctccccacagccagccctcgccaagcaagcagcaggatgtttgcagtgtcgcgcccagggctctga

SEQ ID NO: 127760 - DNA, 489 bp, Homo sapiens; identical to SEQ ID NO: 97820
  misc_feature 1..489: note = chr7:54612317-54612806
  misc_feature 1..489: note = Hyper
  source 1..489: mol_type = genomic DNA

SEQ ID NO: 127761 - DNA, 148 bp, Homo sapiens; identical to SEQ ID NO: 97821
  misc_feature 1..148: note = chr7:54614009-54614157
  misc_feature 1..148: note = Hyper
  source 1..148: mol_type = genomic DNA

SEQ ID NO: 127762 - DNA, 153 bp, Homo sapiens; identical to SEQ ID NO: 97822
  misc_feature 1..153: note = chr7:54614380-54614533
  misc_feature 1..153: note = Hyper
  source 1..153: mol_type = genomic DNA

SEQ ID NO: 127763 - DNA, 38 bp, Homo sapiens; identical to SEQ ID NO: 97823
  misc_feature 1..38: note = chr7:54614739-54614777
  misc_feature 1..38: note = Hyper
  source 1..38: mol_type = genomic DNA

SEQ ID NO: 127764 - DNA, 510 bp, Homo sapiens; identical to SEQ ID NO: 31295
  misc_feature 1..510: note = chr7:54732044-54732554
  misc_feature 1..510: note = Hyper
  source 1..510: mol_type = genomic DNA

SEQ ID NO: 127765 - DNA, 253 bp, Homo sapiens; identical to SEQ ID NO: 97828
  misc_feature 1..253: note = chr7:54794703-54794956
  misc_feature 1..253: note = Hypo
  source 1..253: mol_type = genomic DNA

SEQ ID NO: 127766 - DNA, 19 bp, Homo sapiens
  misc_feature 1..19: note = chr7:54846014-54846033
  misc_feature 1..19: note = Hypo
  source 1..19: mol_type = genomic DNA
tgccatggctgggcacggt

SEQ ID NO: 127767 - DNA, 30 bp, Homo sapiens; identical to SEQ ID NO: 41329
  misc_feature 1..30: note = chr7:54866907-54866937
  misc_feature 1..30: note = Hypo
  source 1..30: mol_type = genomic DNA

SEQ ID NO: 127768 - DNA, 118 bp, Homo sapiens; identical to SEQ ID NO: 97833
  misc_feature 1..118: note = chr7:55086571-55086689
  misc_feature 1..118: note = Hyper
  source 1..118: mol_type = genomic DNA

SEQ ID NO: 127769 - DNA, 820 bp, Homo sapiens; identical to SEQ ID NO: 97834
  misc_feature 1..820: note = chr7:55086983-55087803
  misc_feature 1..820: note = Hyper
  source 1..820: mol_type = genomic DNA

SEQ ID NO: 127770 - DNA, 135 bp, Homo sapiens; identical to SEQ ID NO: 97835
  misc_feature 1..135: note = chr7:55145845-55145980
  misc_feature 1..135: note = Hypo
  source 1..135: mol_type = genomic DNA

SEQ ID NO: 127771 - DNA, 194 bp, Homo sapiens; identical to SEQ ID NO: 97842
  misc_feature 1..194: note = chr7:55382606-55382800
  misc_feature 1..194: note = Hypo
  source 1..194: mol_type = genomic DNA

SEQ ID NO: 127772 - DNA, 305 bp, Homo sapiens; identical to SEQ ID NO: 97843
  misc_feature 1..305: note = chr7:55410019-55410324
  misc_feature 1..305: note = Hypo
  source 1..305: mol_type = genomic DNA

SEQ ID NO: 127773 - DNA, 30 bp, Homo sapiens; identical to SEQ ID NO: 97844
  misc_feature 1..30: note = chr7:55432093-55432123
  misc_feature 1..30: note = Hypo
  source 1..30: mol_type = genomic DNA

SEQ ID NO: 127774 - DNA, 30 bp, Homo sapiens; identical to SEQ ID NO: 97845
  misc_feature 1..30: note = chr7:55570199-55570229
  misc_feature 1..30: note = Hypo
  source 1..30: mol_type = genomic DNA

SEQ ID NO: 127775 - DNA, 157 bp, Homo sapiens; identical to SEQ ID NO: 97848
  misc_feature 1..157: note = chr7:55838624-55838781
  misc_feature 1..157: note = Hypo
  source 1..157: mol_type = genomic DNA

SEQ ID NO: 127776 - DNA, 19 bp, Homo sapiens
  misc_feature 1..19: note = chr7:55940140-55940159
  misc_feature 1..19: note = Hypo
  source 1..19: mol_type = genomic DNA
tttatttttttgagacgga

SEQ ID NO: 127777 - DNA, 360 bp, Homo sapiens; identical to SEQ ID NO: 97851
  misc_feature 1..360: note = chr7:56017869-56018229
  misc_feature 1..360: note = Hypo
  source 1..360: mol_type = genomic DNA

SEQ ID NO: 127778 - DNA, 240 bp, Homo sapiens; identical to SEQ ID NO: 97853
  misc_feature 1..240: note = chr7:56018469-56018709
  misc_feature 1..240: note = Hypo
  source 1..240: mol_type = genomic DNA

SEQ ID NO: 127779 - DNA, 23 bp, Homo sapiens
  misc_feature 1..23: note = chr7:56031846-56031869
  misc_feature 1..23: note = Hypo
  source 1..23: mol_type = genomic DNA
tgttaaagcgttgtggggctttt

SEQ ID NO: 127780 - DNA, 25 bp, Homo sapiens
  misc_feature 1..25: note = chr7:56120758-56120783
  misc_feature 1..25: note = Hypo
  source 1..25: mol_type = genomic DNA
ttaccaggcccgtgcccagctgggt

SEQ ID NO: 127781 - DNA, 30 bp, Homo sapiens; identical to SEQ ID NO: 41334
  misc_feature 1..30: note = chr7:56144506-56144536
  misc_feature 1..30: note = Hypo
  source 1..30: mol_type = genomic DNA

SEQ ID NO: 127782 - DNA, 17 bp, Homo sapiens
  misc_feature 1..17: note = chr7:56172896-56172913
  misc_feature 1..17: note = Hypo
  source 1..17: mol_type = genomic DNA
cccggccactttaatct

SEQ ID NO: 127783 - DNA, 35 bp, Homo sapiens; identical to SEQ ID NO: 97861
  misc_feature 1..35: note = chr7:56176289-56176324
  misc_feature 1..35: note = Hypo
  source 1..35: mol_type = genomic DNA

SEQ ID NO: 127784 - DNA, 597 bp, Homo sapiens
  misc_feature 1..597: note = chr7:56183581-56184178
  misc_feature 1..597: note = Hyper
  source 1..597: mol_type = genomic DNA
tgcggttccctaatacggttccctcagaggcagccgactctgcccagggcgagcagcgccgcgccgtggggggacgctcctagggtccccggggcactggttgggggaggtgttgggcgcacgtacccaggctcaggtgaggcgagtgcgcatcttgggatgcagctggcgctggcggcgcttgcgctggccattgaggagcttctgcgcgaccttgcgctcgtgcccgccaggtgcaggccagttggtgcgcagcgcctgctcgcgccgagtccggcccttgctgcgccctgccccgcaggccgggaagtcgcgcaggtagtagtagtccaggcagtcgtaaagctcctcctcgtagcttatgggtggcggcggccgagccagagcctgcagacgtggaagcgcccgctctgcgggcgcttccatcctgcccaggcctgtggccaccggcggccacctgcccgcgtctgggcgctcctggaagacccagcagccccgcctcgagttccgatgggctccgcgtgaaggtgggggtgccttcggcgacgccacagaggcggaccttcgacgacgtcacagtggcggtacagtgcctgg

SEQ ID NO: 127785 - DNA, 30 bp, Homo sapiens
  misc_feature 1..30: note = chr7:56243024-56243054
  misc_feature 1..30: note = Hyper
  source 1..30: mol_type = genomic DNA
aggcggtggctgcaacgaggaggagctggg

SEQ ID NO: 127786 - DNA, 251 bp, Homo sapiens
  misc_feature 1..251: note = chr7:56355493-56355744
  misc_feature 1..251: note = Hyper
  source 1..251: mol_type = genomic DNA
cccgcgcggcacagacgcggggagcgcgcttggcgctgacacagcggcgacggcggcggcgttagccggcgctcgagctgtttcccttcctggggcgccgaccccgcccgcttgcttgcttgcctgcctgcctgcctgcctggcgccatgcaagagaaggtgccaggggacgcggagcgacgagaggcgcgcggtcccggacagctccgtctctggcgttggcgctgcagccgtgacggaggactacggcg

SEQ ID NO: 127787 - DNA, 167 bp, Homo sapiens; identical to SEQ ID NO: 97875
  misc_feature 1..167: note = chr7:57247720-57247887
  misc_feature 1..167: note = Hypo
  source 1..167: mol_type = genomic DNA

SEQ ID NO: 127788 - DNA, 45 bp, Homo sapiens; identical to SEQ ID NO: 97876
  misc_feature 1..45: note = chr7:57259548-57259593
  misc_feature 1..45: note = Hypo
  source 1..45: mol_type = genomic DNA

SEQ ID NO: 127789 - DNA, 104 bp, Homo sapiens; identical to SEQ ID NO: 97877
  misc_feature 1..104: note = chr7:57259653-57259757
  misc_feature 1..104: note = Hypo
  source 1..104: mol_type = genomic DNA

SEQ ID NO: 127790 - DNA, 21 bp, Homo sapiens
  misc_feature 1..21: note = chr7:57655640-57655661
  misc_feature 1..21: note = Hypo
  source 1..21: mol_type = genomic DNA
ccaccgcgcctggcccatata

SEQ ID NO: 127791 - DNA, 30 bp, Homo sapiens; identical to SEQ ID NO: 97879
  misc_feature 1..30: note = chr7:57832360-57832390
  misc_feature 1..30: note = Hypo
  source 1..30: mol_type = genomic DNA

SEQ ID NO: 127792 - DNA, 17 bp, Homo sapiens
  misc_feature 1..17: note = chr7:57928223-57928240
  misc_feature 1..17: note = Hyper
  source 1..17: mol_type = genomic DNA
accgggggaaaaagccg

SEQ ID NO: 127793 - DNA, 30 bp, Homo sapiens; identical to SEQ ID NO: 97897
  misc_feature 1..30: note = chr7:63020296-63020326
  misc_feature 1..30: note = Hypo
  source 1..30: mol_type = genomic DNA

SEQ ID NO: 127794 - DNA, 24 bp, Homo sapiens
  misc_feature 1..24: note = chr7:63393338-63393362
  misc_feature 1..24: note = Hypo
  source 1..24: mol_type = genomic DNA
gtgcctggccggtttggaagaaat

SEQ ID NO: 127795 - DNA, 30 bp, Homo sapiens; identical to SEQ ID NO: 97899
  misc_feature 1..30: note = chr7:63562154-63562184
  misc_feature 1..30: note = Hypo
  source 1..30: mol_type = genomic DNA

SEQ ID NO: 127796 - DNA, 46 bp, Homo sapiens; identical to SEQ ID NO: 97900
  misc_feature 1..46: note = chr7:63574716-63574762
  misc_feature 1..46: note = Hypo
  source 1..46: mol_type = genomic DNA

SEQ ID NO: 127797 - DNA, 156 bp, Homo sapiens; identical to SEQ ID NO: 97901
  misc_feature 1..156: note = chr7:63652683-63652839
  misc_feature 1..156: note = Hypo
  source 1..156: mol_type = genomic DNA

SEQ ID NO: 127798 - DNA, 180 bp, Homo sapiens; identical to SEQ ID NO: 97902
  misc_feature 1..180: note = chr7:63666583-63666763
  misc_feature 1..180: note = Hypo
  source 1..180: mol_type = genomic DNA

SEQ ID NO: 127799 - DNA, 30 bp, Homo sapiens; identical to SEQ ID NO: 97903
  misc_feature 1..30: note = chr7:63709605-63709635
  misc_feature 1..30: note = Hypo
  source 1..30: mol_type = genomic DNA

SEQ ID NO: 127800 - DNA, 30 bp, Homo sapiens; identical to SEQ ID NO: 97904
  misc_feature 1..30: note = chr7:63767097-63767127
  misc_feature 1..30: note = Hyper
  source 1..30: mol_type = genomic DNA

SEQ ID NO: 127801 - DNA, 503 bp, Homo sapiens; identical to SEQ ID NO: 97905
  misc_feature 1..503: note = chr7:63767577-63768080
  misc_feature 1..503: note = Hyper
  source 1..503: mol_type = genomic DNA

SEQ ID NO: 127802 - DNA, 30 bp, Homo sapiens; identical to SEQ ID NO: 97906
  misc_feature 1..30: note = chr7:63804386-63804416
  misc_feature 1..30: note = Hypo
  source 1..30: mol_type = genomic DNA

SEQ ID NO: 127803 - DNA, 156 bp, Homo sapiens; identical to SEQ ID NO: 97907
  misc_feature 1..156: note = chr7:63813303-63813459
  misc_feature 1..156: note = Hypo
  source 1..156: mol_type = genomic DNA

SEQ ID NO: 127804 - DNA, 40 bp, Homo sapiens; identical to SEQ ID NO: 97909
  misc_feature 1..40: note = chr7:63867671-63867711
  misc_feature 1..40: note = Hypo
  source 1..40: mol_type = genomic DNA

SEQ ID NO: 127805 - DNA, 38 bp, Homo sapiens; identical to SEQ ID NO: 97910
  misc_feature 1..38: note = chr7:63931021-63931059
  misc_feature 1..38: note = Hypo
  source 1..38: mol_type = genomic DNA

SEQ ID NO: 127806 - DNA, 107 bp, Homo sapiens
  misc_feature 1..107: note = chr7:64030014-64030121
  misc_feature 1..107: note = Hyper
  source 1..107: mol_type = genomic DNA
gcaccttcaggccctcggccgtgccgctgctcagtagtctgtcatccttataccactggaaatccgcgggggaaaccgccatggcttcgcagcgcagtaggcggccc

SEQ ID NO: 127807 - DNA, 146 bp, Homo sapiens
  misc_feature 1..146: note = chr7:64030481-64030627
  misc_feature 1..146: note = Hyper
  source 1..146: mol_type = genomic DNA
aggtgtagaggccctcgtcgccgagccccacctcggtgacgaggatggagaactcctcgggggtgttgatgagcagccgcacccgcgggtccctggtcctgcggtcgttgccggcgtacaggatgttggagcggttcagccaggcc

SEQ ID NO: 127808 - DNA, 139 bp, Homo sapiens; identical to SEQ ID NO: 97912
  misc_feature 1..139: note = chr7:64030846-64030985
  misc_feature 1..139: note = Hyper
  source 1..139: mol_type = genomic DNA

SEQ ID NO: 127809 - DNA, 301 bp, Homo sapiens; identical to SEQ ID NO: 97914
  misc_feature 1..301: note = chr7:64330254-64330555
  misc_feature 1..301: note = Hypo
  source 1..301: mol_type = genomic DNA

SEQ ID NO: 127810 - DNA, 153 bp, Homo sapiens; identical to SEQ ID NO: 97915
  misc_feature 1..153: note = chr7:64337977-64338130
  misc_feature 1..153: note = Hyper
  source 1..153: mol_type = genomic DNA

SEQ ID NO: 127811 - DNA, 30 bp, Homo sapiens; identical to SEQ ID NO: 97916
  misc_feature 1..30: note = chr7:64340264-64340294
  misc_feature 1..30: note = Hypo
  source 1..30: mol_type = genomic DNA

SEQ ID NO: 127812 - DNA, 50 bp, Homo sapiens; identical to SEQ ID NO: 97917
  misc_feature 1..50: note = chr7:64345161-64345211
  misc_feature 1..50: note = Hypo
  source 1..50: mol_type = genomic DNA

SEQ ID NO: 127813 - DNA, 113 bp, Homo sapiens
  misc_feature 1..113: note = chr7:64349026-64349139
  misc_feature 1..113: note = Hyper
  source 1..113: mol_type = genomic DNA
ccctgaccagggggccgcgtcttcggcaaagtcttcggggtgagaggtccggctcctggaggacagcgggatgggagagtcccgttcacacccagccccgcagagccggatag

SEQ ID NO: 127814 - DNA, 55 bp, Homo sapiens; identical to SEQ ID NO: 97919
  misc_feature 1..55: note = chr7:64349409-64349464
  misc_feature 1..55: note = Hyper
  source 1..55: mol_type = genomic DNA

SEQ ID NO: 127815 - DNA, 36 bp, Homo sapiens; identical to SEQ ID NO: 97920
  misc_feature 1..36: note = chr7:64350000-64350036
  misc_feature 1..36: note = Hyper
  source 1..36: mol_type = genomic DNA

SEQ ID NO: 127816 - DNA, 78 bp, Homo sapiens; identical to SEQ ID NO: 97921
  misc_feature 1..78: note = chr7:64362694-64362772
  misc_feature 1..78: note = Hypo
  source 1..78: mol_type = genomic DNA

SEQ ID NO: 127817 - DNA, 492 bp, Homo sapiens
  misc_feature 1..492: note = chr7:64407742-64408234
  misc_feature 1..492: note = Hyper
  source 1..492: mol_type = genomic DNA
cgctctcccacctagcggggacccccagccccgccagccgcatcgctctgtccctctcatgtcaggcaagccagttccggaccgcgtggcaccaggagccgccaggagccggggcgacccagaggtctccagcgacctggcgtccggcgaggacacagcccccaggaggggttagaccacgggagccggagcccgagtcccagggccgccgagccagtttagagtggtctccaggccctagtgggaaggggctccgcgcttctgggcgtccacaggagctgcatggccctgcccgctgacgcccggtcgggacgctccacaccctgtgtgggggcggaggggacgcggtgggtgcggcctgggcgcgggtgggctagagcctggagaccgccgggagcccgacttcctggcgctttgccctttggggagcggagccaaggaacagcgccaacctctctccacaagccagggaccctacgacccaccgccgca

SEQ ID NO: 127818 - DNA, 17 bp, Homo sapiens
  misc_feature 1..17: note = chr7:64416654-64416671
  misc_feature 1..17: note = Hypo
  source 1..17: mol_type = genomic DNA
gccgccagtgggctctt

SEQ ID NO: 127819 - DNA, 29 bp, Homo sapiens
  misc_feature 1..29: note = chr7:64450761-64450790
  misc_feature 1..29: note = Hypo
  source 1..29: mol_type = genomic DNA
tggccactggcccagcggattaacatcca

SEQ ID NO: 127820 - DNA, 131 bp, Homo sapiens; identical to SEQ ID NO: 97930
  misc_feature 1..131: note = chr7:64458258-64458389
  misc_feature 1..131: note = Hypo
  source 1..131: mol_type = genomic DNA

SEQ ID NO: 127821 - DNA, 79 bp, Homo sapiens; identical to SEQ ID NO: 97931
  misc_feature 1..79: note = chr7:64459087-64459166
  misc_feature 1..79: note = Hypo
  source 1..79: mol_type = genomic DNA

SEQ ID NO: 127822 - DNA, 39 bp, Homo sapiens; identical to SEQ ID NO: 97932
  misc_feature 1..39: note = chr7:64540683-64540722
  misc_feature 1..39: note = Hypo
  source 1..39: mol_type = genomic DNA

SEQ ID NO: 127823 - DNA, 428 bp, Homo sapiens; identical to SEQ ID NO: 97934
  misc_feature 1..428: note = chr7:64700283-64700711
  misc_feature 1..428: note = Hyper
  source 1..428: mol_type = genomic DNA

SEQ ID NO: 127824 - DNA, 806 bp, Homo sapiens; identical to SEQ ID NO: 97935
  misc_feature 1..806: note = chr7:64712198-64713004
  misc_feature 1..806: note = Hyper
  source 1..806: mol_type = genomic DNA

SEQ ID NO: 127825 - DNA, 642 bp, Homo sapiens; identical to SEQ ID NO: 97936
  misc_feature 1..642: note = chr7:64734196-64734838
  misc_feature 1..642: note = Hyper
  source 1..642: mol_type = genomic DNA

SEQ ID NO: 127826 - DNA, 22 bp, Homo sapiens
  misc_feature 1..22: note = chr7:64824069-64824091
  misc_feature 1..22: note = Hypo
  source 1..22: mol_type = genomic DNA
ccgcacccggcaataaacactt

SEQ ID NO: 127827 - DNA, 180 bp, Homo sapiens; identical to SEQ ID NO: 97938
  misc_feature 1..180: note = chr7:64974268-64974448
  misc_feature 1..180: note = Hyper
  source 1..180: mol_type = genomic DNA

SEQ ID NO: 127828 - DNA, 480 bp, Homo sapiens; identical to SEQ ID NO: 97939
  misc_feature 1..480: note = chr7:64974508-64974988
  misc_feature 1..480: note = Hyper
  source 1..480: mol_type = genomic DNA

SEQ ID NO: 127829 - DNA, 102 bp, Homo sapiens; identical to SEQ ID NO: 31309
  misc_feature 1..102: note = chr7:65037609-65037711
  misc_feature 1..102: note = Hyper
  source 1..102: mol_type = genomic DNA

SEQ ID NO: 127830 - DNA, 23 bp, Homo sapiens
  misc_feature 1..23: note = chr7:65234809-65234832
  misc_feature 1..23: note = Hypo
  source 1..23: mol_type = genomic DNA
attacaggcgtgagccaccatgc

SEQ ID NO: 127831 - DNA, 78 bp, Homo sapiens; identical to SEQ ID NO: 97944
  misc_feature 1..78: note = chr7:65236247-65236325
  misc_feature 1..78: note = Hypo
  source 1..78: mol_type = genomic DNA

SEQ ID NO: 127832 - DNA, 30 bp, Homo sapiens; identical to SEQ ID NO: 97948
  misc_feature 1..30: note = chr7:65441788-65441818
  misc_feature 1..30: note = Hypo
  source 1..30: mol_type = genomic DNA

SEQ ID NO: 127833 - DNA, 91 bp, Homo sapiens; identical to SEQ ID NO: 97949
  misc_feature 1..91: note = chr7:65446021-65446112
  misc_feature 1..91: note = Hyper
  source 1..91: mol_type = genomic DNA

SEQ ID NO: 127834 - DNA, 139 bp, Homo sapiens; identical to SEQ ID NO: 97951
  misc_feature 1..139: note = chr7:65508904-65509043
  misc_feature 1..139: note = Hyper
  source 1..139: mol_type = genomic DNA

SEQ ID NO: 127835 - DNA, 30 bp, Homo sapiens; identical to SEQ ID NO: 97952
  misc_feature 1..30: note = chr7:65509512-65509542
  misc_feature 1..30: note = Hyper
  source 1..30: mol_type = genomic DNA

SEQ ID NO: 127836 - DNA, 43 bp, Homo sapiens; identical to SEQ ID NO: 97953
  misc_feature 1..43: note = chr7:65553975-65554018
  misc_feature 1..43: note = Hypo
  source 1..43: mol_type = genomic DNA

SEQ ID NO: 127837 - DNA, 30 bp, Homo sapiens; identical to SEQ ID NO: 97954
  misc_feature 1..30: note = chr7:65554426-65554456
  misc_feature 1..30: note = Hypo
  source 1..30: mol_type = genomic DNA

SEQ ID NO: 127838 - DNA, 62 bp, Homo sapiens; identical to SEQ ID NO: 97955
  misc_feature 1..62: note = chr7:65575903-65575965
  misc_feature 1..62: note = Hypo
  source 1..62: mol_type = genomic DNA

SEQ ID NO: 127839 - DNA, 22 bp, Homo sapiens
  misc_feature 1..22: note = chr7:65877882-65877904
  misc_feature 1..22: note = Hypo
  source 1..22: mol_type = genomic DNA
tccgtctcgggggggaaaaaaa

SEQ ID NO: 127840 - DNA, 22 bp, Homo sapiens
  misc_feature 1..22: note = chr7:65879595-65879617
  misc_feature 1..22: note = Hypo
  source 1..22: mol_type = genomic DNA
gtaaagtaattgggccggcccc

SEQ ID NO: 127841 - DNA, 81 bp, Homo sapiens; identical to SEQ ID NO: 41342
  misc_feature 1..81: note = chr7:65880043-65880124
  misc_feature 1..81: note = Hypo
  source 1..81: mol_type = genomic DNA

SEQ ID NO: 127842 - DNA, 77 bp, Homo sapiens; identical to SEQ ID NO: 97965
  misc_feature 1..77: note = chr7:65969578-65969655
  misc_feature 1..77: note = Hypo
  source 1..77: mol_type = genomic DNA

SEQ ID NO: 127843 - DNA, 30 bp, Homo sapiens; identical to SEQ ID NO: 97966
  misc_feature 1..30: note = chr7:65973031-65973061
  misc_feature 1..30: note = Hypo
  source 1..30: mol_type = genomic DNA

SEQ ID NO: 127844 - DNA, 17 bp, Homo sapiens
  misc_feature 1..17: note = chr7:66105665-66105682
  misc_feature 1..17: note = Hypo
  source 1..17: mol_type = genomic DNA
gtagtccaggccactcg

SEQ ID NO: 127845 - DNA, 196 bp, Homo sapiens; identical to SEQ ID NO: 97968
  misc_feature 1..196: note = chr7:66105802-66105998
  misc_feature 1..196: note = Hypo
  source 1..196: mol_type = genomic DNA

SEQ ID NO: 127846 - DNA, 30 bp, Homo sapiens; identical to SEQ ID NO: 97969
  misc_feature 1..30: note = chr7:66150814-66150844
  misc_feature 1..30: note = Hypo
  source 1..30: mol_type = genomic DNA

SEQ ID NO: 127847 - DNA, 97 bp, Homo sapiens; identical to SEQ ID NO: 97970
  misc_feature 1..97: note = chr7:66215014-66215111
  misc_feature 1..97: note = Hypo
  source 1..97: mol_type = genomic DNA

SEQ ID NO: 127848 - DNA, 30 bp, Homo sapiens; identical to SEQ ID NO: 97971
  misc_feature 1..30: note = chr7:66293248-66293278
  misc_feature 1..30: note = Hypo
  source 1..30: mol_type = genomic DNA

SEQ ID NO: 127849 - DNA, 30 bp, Homo sapiens; identical to SEQ ID NO: 97975
  misc_feature 1..30: note = chr7:67033662-67033692
  misc_feature 1..30: note = Hypo
  source 1..30: mol_type = genomic DNA

SEQ ID NO: 127850 - DNA, 40 bp, Homo sapiens; identical to SEQ ID NO: 41345
  misc_feature 1..40: note = chr7:67161739-67161779
  misc_feature 1..40: note = Hypo
  source 1..40: mol_type = genomic DNA

SEQ ID NO: 127851 - DNA, 38 bp, Homo sapiens; identical to SEQ ID NO: 97981
  misc_feature 1..38: note = chr7:67478598-67478636
  misc_feature 1..38: note = Hypo
  source 1..38: mol_type = genomic DNA

SEQ ID NO: 127852 - DNA, 17 bp, Homo sapiens
  misc_feature 1..17: note = chr7:67478991-67479008
  misc_feature 1..17: note = Hypo
  source 1..17: mol_type = genomic DNA
gccggtatagggattgt

SEQ ID NO: 127853 - DNA, 30 bp, Homo sapiens; identical to SEQ ID NO: 97983
  misc_feature 1..30: note = chr7:67665226-67665256
  misc_feature 1..30: note = Hypo
  source 1..30: mol_type = genomic DNA

SEQ ID NO: 127854 - DNA, 120 bp, Homo sapiens; identical to SEQ ID NO: 97984
  misc_feature 1..120: note = chr7:68000314-68000434
  misc_feature 1..120: note = Hypo
  source 1..120: mol_type = genomic DNA

SEQ ID NO: 127855 - DNA, 30 bp, Homo sapiens; identical to SEQ ID NO: 97985
  misc_feature 1..30: note = chr7:68149438-68149468
  misc_feature 1..30: note = Hypo
  source 1..30: mol_type = genomic DNA

SEQ ID NO: 127856 - DNA, 30 bp, Homo sapiens; identical to SEQ ID NO: 97986
  misc_feature 1..30: note = chr7:68150297-68150327
  misc_feature 1..30: note = Hypo
  source 1..30: mol_type = genomic DNA

SEQ ID NO: 127857 - DNA, 159 bp, Homo sapiens; identical to SEQ ID NO: 97987
  misc_feature 1..159: note = chr7:68191278-68191437
  misc_feature 1..159: note = Hypo
  source 1..159: mol_type = genomic DNA

SEQ ID NO: 127858 - DNA, 206 bp, Homo sapiens; identical to SEQ ID NO: 97988
  misc_feature 1..206: note = chr7:68204758-68204964
  misc_feature 1..206: note = Hypo
  source 1..206: mol_type = genomic DNA

SEQ ID NO: 127859 - DNA, 20 bp, Homo sapiens
  misc_feature 1..20: note = chr7:68237178-68237198
  misc_feature 1..20: note = Hypo
  source 1..20: mol_type = genomic DNA
gactccgtctcaaaaaaaaa

SEQ ID NO: 127860 - DNA, 185 bp, Homo sapiens; identical to SEQ ID NO: 97990
  misc_feature 1..185: note = chr7:68238305-68238490
  misc_feature 1..185: note = Hypo
  source 1..185: mol_type = genomic DNA

SEQ ID NO: 127861 - DNA, 32 bp, Homo sapiens; identical to SEQ ID NO: 97991
  misc_feature 1..32: note = chr7:68358134-68358166
  misc_feature 1..32: note = Hypo
  source 1..32: mol_type = genomic DNA

SEQ ID NO: 127862 - DNA, 33 bp, Homo sapiens; identical to SEQ ID NO: 97992
  misc_feature 1..33: note = chr7:68527746-68527779
  misc_feature 1..33: note = Hypo
  source 1..33: mol_type = genomic DNA

SEQ ID NO: 127863 - DNA, 30 bp, Homo sapiens; identical to SEQ ID NO: 97993
  misc_feature 1..30: note = chr7:68904116-68904146
  misc_feature 1..30: note = Hypo
  source 1..30: mol_type = genomic DNA

SEQ ID NO: 127864 - DNA, 27 bp, Homo sapiens
  misc_feature 1..27: note = chr7:68982718-68982745
  misc_feature 1..27: note = Hypo
  source 1..27: mol_type = genomic DNA
tgtgagccaccgcgcctggccattgct

SEQ ID NO: 127865 - DNA, 30 bp, Homo sapiens; identical to SEQ ID NO: 97995
  misc_feature 1..30: note = chr7:69033875-69033905
  misc_feature 1..30: note = Hypo
  source 1..30: mol_type = genomic DNA

SEQ ID NO: 127866 - DNA, 42 bp, Homo sapiens; identical to SEQ ID NO: 15004
  misc_feature 1..42: note = chr7:69036110-69036152
  misc_feature 1..42: note = Hypo
  source 1..42: mol_type = genomic DNA

SEQ ID NO: 127867 - DNA, 140 bp, Homo sapiens; identical to SEQ ID NO: 97997
  misc_feature 1..140: note = chr7:69048212-69048352
  misc_feature 1..140: note = Hypo
  source 1..140: mol_type = genomic DNA

SEQ ID NO: 127868 - DNA, 679 bp, Homo sapiens; identical to SEQ ID NO: 97998
  misc_feature 1..679: note = chr7:69062359-69063038
  misc_feature 1..679: note = Hyper
  source 1..679: mol_type = genomic DNA

SEQ ID NO: 127869 - DNA, 93 bp, Homo sapiens; identical to SEQ ID NO: 97999
  misc_feature 1..93: note = chr7:69063459-69063552
  misc_feature 1..93: note = Hyper
  source 1..93: mol_type = genomic DNA

SEQ ID NO: 127870 - DNA, 30 bp, Homo sapiens; identical to SEQ ID NO: 98000
  misc_feature 1..30: note = chr7:69063870-69063900
  misc_feature 1..30: note = Hyper
  source 1..30: mol_type = genomic DNA

SEQ ID NO: 127871 - DNA, 979 bp, Homo sapiens
  misc_feature 1..979: note = chr7:69064182-69065161
  misc_feature 1..979: note = Hyper
  source 1..979: mol_type = genomic DNA
tcggggggcggggggcgcggcggagaatggccgcggggagggctccccggagcctcccagtctcttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggaggtaagggggaccccccttcccccgggttccctttatgcacgaccccactcggctgcgcccggctctcctgcctccctcgccgcgctccgggctgtctgtctgtctgtctgtctgtctgtctgtctaggctgaggtcttattgttggtggggggagctgggggcgcgggcagacaggcagcaggagggagtcgcaaagccgtgcctggtctcgt

SEQ ID NO: 127872 - DNA, 16 bp, Homo sapiens
  misc_feature 1..16: note = chr7:69092470-69092486
  misc_feature 1..16: note = Hypo
  source 1..16: mol_type = genomic DNA
ccgtctcaaaaaaacc

SEQ ID NO: 127873 - DNA, 30 bp, Homo sapiens; identical to SEQ ID NO: 98004
  misc_feature 1..30: note = chr7:69206297-69206327
  misc_feature 1..30: note = Hypo
  source 1..30: mol_type = genomic DNA

SEQ ID NO: 127874 - DNA, 30 bp, Homo sapiens; identical to SEQ ID NO: 98005
  misc_feature 1..30: note = chr7:69217444-69217474
  misc_feature 1..30: note = Hypo
  source 1..30: mol_type = genomic DNA

SEQ ID NO: 127875 - DNA, 215 bp, Homo sapiens; identical to SEQ ID NO: 98006
  misc_feature 1..215: note = chr7:69313658-69313873
  misc_feature 1..215: note = Hypo
  source 1..215: mol_type = genomic DNA

SEQ ID NO: 127876 - DNA, 86 bp, Homo sapiens; identical to SEQ ID NO: 98007
  misc_feature 1..86: note = chr7:69499763-69499849
  misc_feature 1..86: note = Hypo
  source 1..86: mol_type = genomic DNA

SEQ ID NO: 127877 - DNA, 25 bp, Homo sapiens
  misc_feature 1..25: note = chr7:69499909-69499934
  misc_feature 1..25: note = Hypo
  source 1..25: mol_type = genomic DNA
tgggcccaagcgatcctctcacctt

SEQ ID NO: 127878 - DNA, 30 bp, Homo sapiens; identical to SEQ ID NO: 98009
  misc_feature 1..30: note = chr7:69510019-69510049
  misc_feature 1..30: note = Hypo
  source 1..30: mol_type = genomic DNA

SEQ ID NO: 127879 - DNA, 146 bp, Homo sapiens; identical to SEQ ID NO: 98011
  misc_feature 1..146: note = chr7:69696309-69696455
  misc_feature 1..146: note = Hypo
  source 1..146: mol_type = genomic DNA

SEQ ID NO: 127880 - DNA, 30 bp, Homo sapiens; identical to SEQ ID NO: 41352
  misc_feature 1..30: note = chr7:69698849-69698879
  misc_feature 1..30: note = Hypo
  source 1..30: mol_type = genomic DNA

SEQ ID NO: 127881 - DNA, 136 bp, Homo sapiens; identical to SEQ ID NO: 98013
  misc_feature 1..136: note = chr7:69745578-69745714
  misc_feature 1..136: note = Hypo
  source 1..136: mol_type = genomic DNA

SEQ ID NO: 127882 - DNA, 227 bp, Homo sapiens; identical to SEQ ID NO: 98014
  misc_feature 1..227: note = chr7:69897720-69897947
  misc_feature 1..227: note = Hypo
  source 1..227: mol_type = genomic DNA

SEQ ID NO: 127883 - DNA, 134 bp, Homo sapiens; identical to SEQ ID NO: 98015
  misc_feature 1..134: note = chr7:70061015-70061149
  misc_feature 1..134: note = Hyper
  source 1..134: mol_type = genomic DNA

SEQ ID NO: 127884 - DNA, 30 bp, Homo sapiens; identical to SEQ ID NO: 98017
  misc_feature 1..30: note = chr7:70311103-70311133
  misc_feature 1..30: note = Hypo
  source 1..30: mol_type = genomic DNA

SEQ ID NO: 127885 - DNA, 1122 bp, Homo sapiens
  misc_feature 1..1122: note = chr7:70596147-70597269
  misc_feature 1..1122: note = Hyper
  source 1..1122: mol_type = genomic DNA
atttgaacagagcagcgggtgggcctagaagcagtgactggggaggttagaattcttgcacgcagagaacccccccaagcccgctcacgcccggcctggctccgaaggtctcagaatccgagcctccaggccagattttccctctagccattcctggccacgcagcgcggagccgcgagcacacagaaaaggatgtcttcatcgccaaccgggatggaacgaacccgcccgctcagggagtactgagaactaaagggtccctccagcgccggccgcagccagcatgccttgactgcctccatcccgcgcggtccccactctccagaagcccccgccctgcccgggtgcgcgcgcgcacgagtcggcgaaccggggagctgtgcgctcggcagcctgcgggcggcggcggcggccgccgacagcctctcggggacagggtggcgaagagcggcggaggaggagctggcgccgccgccgctcccctcgggccgcgccccgccctccgccgccacctgcgcgtcccctccgggctcctcagctccggggctgtgtggctctcggtgccgcagcggcggtgtcaccgcgtccgccaattgggagactcggcgttttggctcccgggggcgcgggacgagccgcgcggccggatctggcgagcggagggtgattcggcacgcgtacctccccgccgcgctgcccgcgacgttttgggagggggtagagaactgctgtgacttttgaggtccgactccttccggccagcctcgcgacgcgccagctccgagacaggccggtgtgccctgaaggccccgaaggctctcggcgcggtttgggggcttggaacgtgtccgggagccggcggcgctgtgagcgctggtgagtttgccggcggggtggggtggactccgcgcggggggcggagaggacgtagcgctcggcccggcgcccgccccctagtgctgcccccactttgagagtaattgagacttgagcgtgactgcggagcctggaggatgcgggctccccgagcgggcttcccctctgcccggcgcgatggagcgggtcggtgagcggaacaaaggcgcctgcccgggggagcgggtcttccgctgaagagcgcgg

SEQ ID NO: 127886 - DNA, 168 bp, Homo sapiens; identical to SEQ ID NO: 98020
  misc_feature 1..168: note = chr7:70597490-70597658
  misc_feature 1..168: note = Hyper
  source 1..168: mol_type = genomic DNA

SEQ ID NO: 127887 - DNA, 632 bp, Homo sapiens
  misc_feature 1..632: note = chr7:70597883-70598515
  misc_feature 1..632: note = Hyper
  source 1..632: mol_type = genomic DNA
ggtgcgcagcggagacgccttccacgagatccggccgcgcgccgaggtggccaacctcagcgcgcacagcgccagccccatccaggatgcggtcctgaagcgcctgtcgctgctggaggacatcgtgtaccggcagctgaatggtaaggacgcacgccggcgcctccggggctcgacgcgggcgggccgggcacagggtgagccccagggtccttgcgcgctgcgccctgtgcctgggagccggcacaccctggctcccgcgcgctccttcttacccttcctgccccgtttcgggcagatggccggggctgctggaaagaacaacttgcctgattcttttctgtgccccacctgcaaatttggttttatcctggaaacatgtcagtacagttggctcccggtccccgcgtgcggactggaaatcattccctggcgactccagcccgagcgcagaaactagtggaggggccacatgggactggaggcgcgcgggcagacgtgtaggaggaaatagtcttagagcccagcgtttggtggggtaccagtagggaacctgggagattggagggcttggatgtctgcagacaaagtcaaggccccaggtcgcggagctaatgcgcttaggtagtata

SEQ ID NO: 127888 - DNA, 30 bp, Homo sapiens; identical to SEQ ID NO: 98023
  misc_feature 1..30: note = chr7:70699941-70699971
  misc_feature 1..30: note = Hypo
  source 1..30: mol_type = genomic DNA

SEQ ID NO: 127889 - DNA, 39 bp, Homo sapiens; identical to SEQ ID NO: 98024
  misc_feature 1..39: note = chr7:70728615-70728654
  misc_feature 1..39: note = Hypo
  source 1..39: mol_type = genomic DNA

SEQ ID NO: 127890 - DNA, 30 bp, Homo sapiens; identical to SEQ ID NO: 98025
  misc_feature 1..30: note = chr7:70802549-70802579
  misc_feature 1..30: note = Hypo
  source 1..30: mol_type = genomic DNA

SEQ ID NO: 127891 - DNA, 138 bp, Homo sapiens; identical to SEQ ID NO: 98026
  misc_feature 1..138: note = chr7:70840301-70840439
  misc_feature 1..138: note = Hypo
  source 1..138: mol_type = genomic DNA

SEQ ID NO: 127892 - DNA, 39 bp, Homo sapiens; identical to SEQ ID NO: 98042
  misc_feature 1..39: note = chr7:71211002-71211041
  misc_feature 1..39: note = Hypo
  source 1..39: mol_type = genomic DNA

SEQ ID NO: 127893 - DNA, 245 bp, Homo sapiens; identical to SEQ ID NO: 98043
  misc_feature 1..245: note = chr7:71217033-71217278
  misc_feature 1..245: note = Hyper
  source 1..245: mol_type = genomic DNA

SEQ ID NO: 127894 - DNA, 30 bp, Homo sapiens; identical to SEQ ID NO: 98044
  misc_feature 1..30: note = chr7:71252818-71252848
  misc_feature 1..30: note = Hypo
  source 1..30: mol_type = genomic DNA

SEQ ID NO: 127895 - DNA, 30 bp, Homo sapiens; identical to SEQ ID NO: 98045
  misc_feature 1..30: note = chr7:71265604-71265634
  misc_feature 1..30: note = Hypo
  source 1..30: mol_type = genomic DNA

SEQ ID NO: 127896 - DNA, 150 bp, Homo sapiens; identical to SEQ ID NO: 98046
  misc_feature 1..150: note = chr7:71296028-71296178
  misc_feature 1..150: note = Hypo
  source 1..150: mol_type = genomic DNA

SEQ ID NO: 127897 - DNA, 79 bp, Homo sapiens; identical to SEQ ID NO: 98047
  misc_feature 1..79: note = chr7:71299737-71299816
  misc_feature 1..79: note = Hypo
  source 1..79: mol_type = genomic DNA

SEQ ID NO: 127898 - DNA, 30 bp, Homo sapiens; identical to SEQ ID NO: 98048
  misc_feature 1..30: note = chr7:71398187-71398217
  misc_feature 1..30: note = Hypo
  source 1..30: mol_type = genomic DNA

SEQ ID NO: 127899 - DNA, 34 bp, Homo sapiens; identical to SEQ ID NO: 98049
  misc_feature 1..34: note = chr7:71416278-71416312
  misc_feature 1..34: note = Hypo
  source 1..34: mol_type = genomic DNA

SEQ ID NO: 127900 - DNA, 216 bp, Homo sapiens; identical to SEQ ID NO: 98050
  misc_feature 1..216: note = chr7:71420713-71420929
  misc_feature 1..216: note = Hypo
  source 1..216: mol_type = genomic DNA

SEQ ID NO: 127901 - DNA, 143 bp, Homo sapiens; identical to SEQ ID NO: 98051
  misc_feature 1..143: note = chr7:71472525-71472668
  misc_feature 1..143: note = Hypo
  source 1..143: mol_type = genomic DNA

SEQ ID NO: 127902 - DNA, 41 bp, Homo sapiens; identical to SEQ ID NO: 98052
  misc_feature 1..41: note = chr7:71643690-71643731
  misc_feature 1..41: note = Hypo
  source 1..41: mol_type = genomic DNA

SEQ ID NO: 127903 - DNA, 76 bp, Homo sapiens; identical to SEQ ID NO: 98053
  misc_feature 1..76: note = chr7:71669270-71669346
  misc_feature 1..76: note = Hypo
  source 1..76: mol_type = genomic DNA

SEQ ID NO: 127904 - DNA, 198 bp, Homo sapiens; identical to SEQ ID NO: 98054
  misc_feature 1..198: note = chr7:71737907-71738105
  misc_feature 1..198: note = Hypo
  source 1..198: mol_type = genomic DNA

SEQ ID NO: 127905 - DNA, 39 bp, Homo sapiens; identical to SEQ ID NO: 98055
  misc_feature 1..39: note = chr7:71775955-71775994
  misc_feature 1..39: note = Hypo
  source 1..39: mol_type = genomic DNA

SEQ ID NO: 127906 - DNA, 1765 bp, Homo sapiens
  misc_feature 1..1765: note = chr7:71800631-71802396
  misc_feature 1..1765: note = Hyper
  source 1..1765: mol_type = genomic DNA
gggaactgcaggcaccgcttcacccaggagctacgggcttcgacccaaatggaagaaaggcgccttcctcacacaagcctcgtccaagaaaaaagagcagtgggaaacgatggtgggctggtggcccgggcgcacgtggcccaaggctaagacgcaagccgatcccctcggtgcacgctctgtacccccagcccgtctggatggggcgtcccccgctcgccctcgccccaagggtggcccagaactacctgctgctgcctaggcgccctcggaccaagtctcgggaagttcactccgcgctgcgctagtccggagaaactaggaacccgagtaaacccagactgtccggggaagacggatcccacccccacctgggcgccagacccatccagctgcttggagctcagagactaggtcccagccggactgcagaggcctctctggttaccccttgcaccctggcgcccccggactcggggtgggtggcggcgaggagcgtgcgcccagaaaggcaagcagtcagcgctaggggccggaggtggagagaaccctgcctcccgcctcccccgatcgccatgactccggcttcgcgaagagacctggttgccgccgggcgctcccacctgggctgcggtgcggctccgagtcccctgccctccctccccatcgcccgggcgcctgcgggcgggggcgcgcagcctggtggccactggcgcctgggggctagaagagcggctcccagcctccagcccgcacggtgccgggacagccgagtccgccgcggcccttccctagccccacgtccccaggcaggcggccaggagccagctccacggaaggcaaggtggccggcgcggcccccagcccgcggggtgggtgccccagtgtcggagccaacaggtacgggaggcgctgtctgccaaccatctgcccactctgagcaccagggcccgcgacagcccgggggtttggacaccctagagagaagcgaggaccgagggaagaagaaaagagagcgcgcgcgcgggtaagctagggagccggcggcggcactcacctcttgctgggccggggctccgcagcccggcagccgaggcgcctccgcacagcgcggggggcttcctccgaggcccgcagggagggggcggtgcggaatggatgcgccgagcgggcagcgctcagcctctcgctcacacccccagcaggcagccgcgtccccgtgccggcatcctcgctgccgccggctccctcggcgcccccgggccgctccccacgcgcgcgccgggacctgcacgagccccctcgtcgactcggagcgcgatctgggcgcgtgcctccctgtccttgtcctctgctctcgtctggggacgtgtgccccgcaccccctgcaccgcgcgctcctctacccctcccgctcccgctggccgcgcgggttcagcccatgtgcgcggctgcctcgctgcgccccggagcccagtggccgaggccccgctggagttgcgcgccctagaaactccatgcagctccggcctcctccccagctcctccccagcggatcccccagggccttgccgccgacagcaccacactcctcgctctgccggcgcccgcgttcaggagccgggcttctgggctcgccttggccgcctgcgccccagctcctccgagggtcggggagcccccaccccccaacctccgcctctccaatggctccctcggtttccaagcagcgcaacctgaggaacgcctcggcgcgcgcgcactc

SEQ ID NO: 127907 - DNA, 325 bp, Homo sapiens
  misc_feature 1..325: note = chr7:71802456-71802781
  misc_feature 1..325: note = Hyper
  source 1..325: mol_type = genomic DNA
cacgcggggggcgagcaggcgcttggcagacggtgctccttccttcccttcccaaagaggctgcccacgttaactccggcaaactgctgctcctcagcacaggacaactcaccctagcgcccgccgccttcactacttcatcccaggtgcccacaccctagatccacgattacacctgagcccagggggaaggcggggcgccgaagtggaggggccaatggccgaaactgcggggaccagcattccgcgtgaccgcccctggagacgtccagggaggcacggctgccgcagggcatcgcccacccaccagcgatcccactcctcc

SEQ ID NO: 127908 - DNA, 30 bp, Homo sapiens; identical to SEQ ID NO: 98062
  misc_feature 1..30: note = chr7:71871052-71871082
  misc_feature 1..30: note = Hypo
  source 1..30: mol_type = genomic DNA

SEQ ID NO: 127909 - DNA, 25 bp, Homo sapiens
  misc_feature 1..25: note = chr7:71877300-71877325
  misc_feature 1..25: note = Hypo
  source 1..25: mol_type = genomic DNA
cggatagcaccccagcgagcttccc

SEQ ID NO: 127910 - DNA, 30 bp, Homo sapiens; identical to SEQ ID NO: 41356
  misc_feature 1..30: note = chr7:71880817-71880847
  misc_feature 1..30: note = Hypo
  source 1..30: mol_type = genomic DNA

SEQ ID NO: 127911 - DNA, 183 bp, Homo sapiens; identical to SEQ ID NO: 98065
  misc_feature 1..183: note = chr7:71912763-71912946
  misc_feature 1..183: note = Hypo
  source 1..183: mol_type = genomic DNA

SEQ ID NO: 127912 - DNA, 30 bp, Homo sapiens; identical to SEQ ID NO: 41357
  misc_feature 1..30: note = chr7:75975426-75975456
  misc_feature 1..30: note = Hypo
  source 1..30: mol_type = genomic DNA

SEQ ID NO: 127913 - DNA, 30 bp, Homo sapiens; identical to SEQ ID NO: 98073
  misc_feature 1..30: note = chr7:76033259-76033289
  misc_feature 1..30: note = Hypo
  source 1..30: mol_type = genomic DNA

SEQ ID NO: 127914 - DNA, 49 bp, Homo sapiens; identical to SEQ ID NO: 41358
  misc_feature 1..49: note = chr7:76106331-76106380
  misc_feature 1..49: note = Hypo
  source 1..49: mol_type = genomic DNA

SEQ ID NO: 127915 - DNA, 185 bp, Homo sapiens; identical to SEQ ID NO: 98078
  misc_feature 1..185: note = chr7:76145361-76145546
  misc_feature 1..185: note = Hyper
  source 1..185: mol_type = genomic DNA

SEQ ID NO: 127916 - DNA, 30 bp, Homo sapiens; identical to SEQ ID NO: 98079
  misc_feature 1..30: note = chr7:76604327-76604357
  misc_feature 1..30: note = Hypo
  source 1..30: mol_type = genomic DNA

SEQ ID NO: 127917 - DNA, 93 bp, Homo sapiens; identical to SEQ ID NO: 98080
  misc_feature 1..93: note = chr7:76631511-76631604
  misc_feature 1..93: note = Hypo
  source 1..93: mol_type = genomic DNA

SEQ ID NO: 127918 - DNA, 40 bp, Homo sapiens; identical to SEQ ID NO: 98081
  misc_feature 1..40: note = chr7:76751676-76751716
  misc_feature 1..40: note = Hyper
  source 1..40: mol_type = genomic DNA

SEQ ID NO: 127919 - DNA, 20 bp, Homo sapiens
  misc_feature 1..20: note = chr7:77051320-77051340
  misc_feature 1..20: note = Hypo
  source 1..20: mol_type = genomic DNA
accaccgtgcccagccaaca

SEQ ID NO: 127920 - DNA, 28 bp, Homo sapiens
  misc_feature 1..28: note = chr7:77309374-77309402
  misc_feature 1..28: note = Hypo
  source 1..28: mol_type = genomic DNA
tggagtgcagtggtccgcctcccgggtt

SEQ ID NO: 127921 - DNA, 28 bp, Homo sapiens
  misc_feature 1..28: note = chr7:77309582-77309610
  misc_feature 1..28: note = Hypo
  source 1..28: mol_type = genomic DNA
aggcgtgagccatcgtgcccggccagac

SEQ ID NO: 127922 - DNA, 93 bp, Homo sapiens; identical to SEQ ID NO: 98085
  misc_feature 1..93: note = chr7:77315389-77315482
  misc_feature 1..93: note = Hypo
  source 1..93: mol_type = genomic DNA

SEQ ID NO: 127923 - DNA, 35 bp, Homo sapiens; identical to SEQ ID NO: 98086
  misc_feature 1..35: note = chr7:77324362-77324397
  misc_feature 1..35: note = Hypo
  source 1..35: mol_type = genomic DNA

SEQ ID NO: 127924 - DNA, 30 bp, Homo sapiens; identical to SEQ ID NO: 98087
  misc_feature 1..30: note = chr7:77413267-77413297
  misc_feature 1..30: note = Hypo
  source 1..30: mol_type = genomic DNA

SEQ ID NO: 127925 - DNA, 28 bp, Homo sapiens
  misc_feature 1..28: note = chr7:77928410-77928438
  misc_feature 1..28: note = Hypo
  source 1..28: mol_type = genomic DNA
aggcgtgagctaccgtgcctggctataa

SEQ ID NO: 127926 - DNA, 97 bp, Homo sapiens; identical to SEQ ID NO: 98089
  misc_feature 1..97: note = chr7:78598432-78598529
  misc_feature 1..97: note = Hypo
  source 1..97: mol_type = genomic DNA

SEQ ID NO: 127927 - DNA, 36 bp, Homo sapiens; identical to SEQ ID NO: 98090
  misc_feature 1..36: note = chr7:78598589-78598625
  misc_feature 1..36: note = Hypo
  source 1..36: mol_type = genomic DNA

SEQ ID NO: 127928 - DNA, 147 bp, Homo sapiens; identical to SEQ ID NO: 98091
  misc_feature 1..147: note = chr7:79081745-79081892
  misc_feature 1..147: note = Hyper
  source 1..147: mol_type = genomic DNA

SEQ ID NO: 127929 - DNA, 420 bp, Homo sapiens; identical to SEQ ID NO: 31327
  misc_feature 1..420: note = chr7:79082159-79082579
  misc_feature 1..420: note = Hyper
  source 1..420: mol_type = genomic DNA

SEQ ID NO: 127930 - DNA, 991 bp, Homo sapiens
  misc_feature 1..991: note = chr7:79083020-79084011
  misc_feature 1..991: note = Hyper
  source 1..991: mol_type = genomic DNA
cactcctgcgtggtgcgagtgggaacgcgcgcgcgcgcctgggtgtgtgttgttagctgatatccatggcagctgcagtggcagggtgcgtgtgcgtgtgtgtgtgtgtgtgtgtgtgtactagttctactgtactggcagacgggaggaggcaggggaggaggggcgcgcgcgccgggtggggagccacggagggcttcgccgctgcctccctccctccctccgcagcttgacccggtagtgaaggcagagagagaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtgagaaggagttggggcgggggacccggcggggcattgcgggagaaggcctgggatccctgggagccttgtagcgtgggggagttcactgtgtagagaggtttcatgtcttcatctatatagtcacttatttgtcttaaagttctcgaaattccctcttagagaaggagaaagttagagaactggaggctgcgtaccctgattacgcagaagggaagcagcctcgcattccccggggcaggcccccgcccgcgcgtcccgccagtaggggaatttagcggacggctgcggttgtctggtgaaaggctatccaaggataaggggcttcacttttcccaagtaggggaaagagaaggggtctacagggctaggggtggagggagcggatgcagtgagcagcctccgcagagaaattgacaatttaaccagggacctgcggcagagacaaggc

SEQ ID NO: 127931 - DNA, 56 bp, Homo sapiens; identical to SEQ ID NO: 98095
  misc_feature 1..56: note = chr7:79764157-79764213
  misc_feature 1..56: note = Hyper
  source 1..56: mol_type = genomic DNA

SEQ ID NO: 127932 - DNA, 241 bp, Homo sapiens; identical to SEQ ID NO: 98096
  misc_feature 1..241: note = chr7:79764471-79764712
  misc_feature 1..241: note = Hyper
  source 1..241: mol_type = genomic DNA

SEQ ID NO: 127933 - DNA, 285 bp, Homo sapiens; identical to SEQ ID NO: 98097
  misc_feature 1..285: note = chr7:79764928-79765213
  misc_feature 1..285: note = Hyper
  source 1..285: mol_type = genomic DNA

SEQ ID NO: 127934 - DNA, 42 bp, Homo sapiens; identical to SEQ ID NO: 98098
  misc_feature 1..42: note = chr7:80134959-80135001
  misc_feature 1..42: note = Hypo
  source 1..42: mol_type = genomic DNA

SEQ ID NO: 127935 - DNA, 183 bp, Homo sapiens; identical to SEQ ID NO: 98099
  misc_feature 1..183: note = chr7:80135488-80135671
  misc_feature 1..183: note = Hypo
  source 1..183: mol_type = genomic DNA

SEQ ID NO: 127936 - DNA, 37 bp, Homo sapiens; identical to SEQ ID NO: 98101
  misc_feature 1..37: note = chr7:80702421-80702458
  misc_feature 1..37: note = Hypo
  source 1..37: mol_type = genomic DNA

SEQ ID NO: 127937 - DNA, 120 bp, Homo sapiens; identical to SEQ ID NO: 98102
  misc_feature 1..120: note = chr7:80790105-80790225
  misc_feature 1..120: note = Hypo
  source 1..120: mol_type = genomic DNA

SEQ ID NO: 127938 - DNA, 30 bp, Homo sapiens; identical to SEQ ID NO: 98105
  misc_feature 1..30: note = chr7:80896305-80896335
  misc_feature 1..30: note = Hypo
  source 1..30: mol_type = genomic DNA

SEQ ID NO: 127939 - DNA, 37 bp, Homo sapiens; identical to SEQ ID NO: 98106
  misc_feature 1..37: note = chr7:81644079-81644116
  misc_feature 1..37: note = Hypo
  source 1..37: mol_type = genomic DNA

SEQ ID NO: 127940 - DNA, 30 bp, Homo sapiens; identical to SEQ ID NO: 98107
  misc_feature 1..30: note = chr7:81928003-81928033
  misc_feature 1..30: note = Hypo
  source 1..30: mol_type = genomic DNA

SEQ ID NO: 127941 - DNA, 697 bp, Homo sapiens
  misc_feature 1..697: note = chr7:82072006-82072703
  misc_feature 1..697: note = Hyper
  source 1..697: mol_type = genomic DNA
ttgaagaacagggaccgcgtgtctgccgacacttagatgtttcaaataatgggttggggaggttggatcgcgtggtcccagtacctgcgagccccctgcgtggacagcacgctcggccgcggggagccagcacgcgtctaatcggaaggctgtcaagtgcatccagtaacgtgggataaaacgagtttgggcactacagcaattaaagagcatctccgaggccaagtgcgggggaagtccacgctacctcggcaagcctgaaattacctgtttgtaaattacccaaccaaaacataactttttattgaactgggttgaatcagagcgggtgagctggctggaaacttttttccccagtacggctgcactctgaagtctagagaatcccgttagagacgggctgagacgccgcgagtcgtcggcgggcgcttcccgggacagtcggcccccagtgcccggccccgtggaggcgcccgagacgccggttcgggacgcattccagcggcgagcggcgcgcaccgcctgcccggcgtctccgcatccgagcctggctccccggccgctcgctccccacccccacgggcggaaaagccccgcgactcgggaaccgacccccacccccaactcccgcggcgcccctcggccggcgctccctgcccggcccgccgacttacgtgacggccgaagggaacggctc

SEQ ID NO: 127942 - DNA, 44 bp, Homo sapiens; identical to SEQ ID NO: 98111
  misc_feature 1..44: note = chr7:82073054-82073098
  misc_feature 1..44: note = Hyper
  source 1..44: mol_type = genomic DNA

SEQ ID NO: 127943 - DNA, 59 bp, Homo sapiens; identical to SEQ ID NO: 31334
  misc_feature 1..59: note = chr7:82791978-82792037
  misc_feature 1..59: note = Hyper
  source 1..59: mol_type = genomic DNA

SEQ ID NO: 127944 - DNA, 34 bp, Homo sapiens; identical to SEQ ID NO: 31335
  misc_feature 1..34: note = chr7:83277925-83277959
  misc_feature 1..34: note = Hyper
  source 1..34: mol_type = genomic DNA

SEQ ID NO: 127945 - DNA, 53 bp, Homo sapiens; identical to SEQ ID NO: 98114
  misc_feature 1..53: note = chr7:83278217-83278270
  misc_feature 1..53: note = Hyper
  source 1..53: mol_type = genomic DNA

SEQ ID NO: 127946 - DNA, 71 bp, Homo sapiens; identical to SEQ ID NO: 31337
  misc_feature 1..71: note = chr7:83824239-83824310
  misc_feature 1..71: note = Hyper
  source 1..71: mol_type = genomic DNA

SEQ ID NO: 127947 - DNA, 30 bp, Homo sapiens; identical to SEQ ID NO: 98123
  misc_feature 1..30: note = chr7:84773311-84773341
  misc_feature 1..30: note = Hypo
  source 1..30: mol_type = genomic DNA

SEQ ID NO: 127948 - DNA, 409 bp, Homo sapiens
  misc_feature 1..409: note = chr7:84814630-84815039
  misc_feature 1..409: note = Hyper
  source 1..409: mol_type = genomic DNA
ggagatcctccccctcgtctctgcgcgcccccaccccgccatcccccgctagcgcacacatgcaggagaaccctttttaggctaaaccggaaagtttaggtcttctcccctcttcttttgcttgtgcaaatagcactaagctaaacggaaagtggtggggttttggtgatgaaataagagtccacgcacagaagcttgccttttattaccgcttcgctcgaggcgaaatcgctgaaagttcggctatttaactcctgtccccataactcggaatcccggacaccagcggccccagctgctggcgcgcggctctcttccagtcccctggatcccaaagctccctgccacagcgcggcgtctcctcctcctgtcaacttccctccttgcactgtgacggaggcaaagcaac

SEQ ID NO: 127949 - DNA, 101 bp, Homo sapiens
  misc_feature 1..101: note = chr7:84815350-84815451
  misc_feature 1..101: note = Hyper
  source 1..101: mol_type = genomic DNA
ttccatcagacggaacgtcgcgattccccggcgaagaaaaaggcgtcgcccattcctcttccaaaacgctacaacaaaaaccaccacgcttcccttccttc

SEQ ID NO: 127950 - DNA, 771 bp, Homo sapiens
  misc_feature 1..771: note = chr7:84815717-84816488
  misc_feature 1..771: note = Hyper
  source 1..771: mol_type = genomic DNA
ctcgtcagaaggctccgcagctgctgaggcggggtgggactgcgccccaggggccgcgctgaagctggcgccgcgattactgcgcaccgatttcgcccactctctgtccgctcccgggagccttctctgtctcaggacggttccttatctcccaaaccatgctcgtcctccacttcggacccacagccacccccaaatcccggctatccccgcttagcaccgcggtctccagcacaccctcccactggagtagcaggtgacccaaaccagacttacctgctgtgaactcttctctccctctctcttttcctggtgccttttcagggagaggggaacgggatgcaggctgaggtccagcggcgcggcaacccggggcaccggcgcgcgttcctctgagccgcagccctggctgagcaagcggagccgccggcagccctggcagagccgggaagctgcggccgcaggggccaggccgggaggcagggggcgctgctgcctcccccgagagccgcgctaggacaggcggagagcaaggcaccagctggagctttggggaggagagggtggcgaggaaaggcacgctccaaacaggagggcggcttttaagtttgtggtgtgaccgcagcagctgtcctgggagagactcagtctttctaaaaagaggatgctgaaaacgccggggattacctttccccttccgatctcctcccccagccctcgccccctccttccactgcgcacgccagaactcccaagcgtgcagaagttcat

SEQ ID NO: 127951 - DNA, 23 bp, Homo sapiens
  misc_feature 1..23: note = chr7:84936791-84936814
  misc_feature 1..23: note = Hypo
  source 1..23: mol_type = genomic DNA
accgcgctcggccttgtttacca

SEQ ID NO: 127952 - DNA, 28 bp, Homo sapiens
  misc_feature 1..28: note = chr7:85220892-85220920
  misc_feature 1..28: note = Hypo
  source 1..28: mol_type = genomic DNA
gatctaggccgggagcggtggctcacgc

SEQ ID NO: 127953 - DNA, 27 bp, Homo sapiens
  misc_feature 1..27: note = chr7:86228129-86228156
  misc_feature 1..27: note = Hypo
  source 1..27: mol_type = genomic DNA
aggaggctgaatccacggggctgagca

SEQ ID NO: 127954 - DNA, 1238 bp, Homo sapiens
  misc_feature 1..1238: note = chr7:86273208-86274446
  misc_feature 1..1238: note = Hyper
  source 1..1238: mol_type = genomic DNA
ccctctccaggggctcgcagtgtgcagttgagtcgcgagtacggctgagctgcgtaccggcctccctggctctcacactccctctctgctcccgctctcctaatctcctctggcatgcggtcagccccctgcccagggaccacaggagagttcttgtaaggactgttagtccctgcttacctgaaagccaagcgctctagcagagctttaaagttggagccgccaccctccctaccgccccatgccccttcaccccactccgaaattcaccgacctttgcatgcactgcctaaggatttcagagtgaggcaaagcagtcggcaaatctaccctggcttttcgtataaaaatcctctcgtctaggtaccctggctcactgaagactctgcagatatacccttataagagggagggtgggggagggaaaagaacgagagagggaggaaagaatgaaaaggagaggatgccaggaggtccgtgcttctgccaagagtcccaattagatgcgacggcttcagcctggtcaaggtgaaggaaagttgcttccgcgcctaggaagtgggtttgcctgataagagaaggaggaggggactcggctgggaagagctcccctcccctccgcggaagaccactgggtcccctctttccccaacctcctccctctcttctactccacccctccgttttcccactccccactgactcggatgcctggatgttctgccaccgggcagtggtccagcgtgcagccgggagggggcaggggcagggggcactgtgacaggaagctgcgcgcacaagttggccatttcgagggcaaaataagttctcccttggatttggaaaggacaaagccagtaagctacctcttttgtgtcggatgaggaggaccaaccatgagccagagcccgggtgcaggctcaccgccgccgctgccaccgcggtcagctccagttcctgccaggagttgtcggtgcgaggtaagggtcccagaggaggacgtgtccctctggagggcgcccagccagggcgcggaagctcgggtgccgcgtggggcaggcgcagccgggaaagttgaggtagagcatggaccagtccctacagtcctgactggagtgggaagggtggagggcagaggcgatgtgggtgtgcatgagtgagagtttgtgtgtgtgcgcccacgtctgtgtctgggaggagggagatttcagggcatagatctgcggccagggtgcgag

SEQ ID NO: 127955 - DNA, 42 bp, Homo sapiens; identical to SEQ ID NO: 41364
  misc_feature 1..42: note = chr7:86416083-86416125
  misc_feature 1..42: note = Hypo
  source 1..42: mol_type = genomic DNA

SEQ ID NO: 127956 - DNA, 102 bp, Homo sapiens; identical to SEQ ID NO: 98142
  misc_feature 1..102: note = chr7:86688425-86688527
  misc_feature 1..102: note = Hyper
  source 1..102: mol_type = genomic DNA

SEQ ID NO: 127957 - DNA, 627 bp, Homo sapiens; identical to SEQ ID NO: 98143
  misc_feature 1..627: note = chr7:87104741-87105368
  misc_feature 1..627: note = Hyper
  source 1..627: mol_type = genomic DNA

SEQ ID NO: 127958 - DNA, 1146 bp, Homo sapiens
  misc_feature 1..1146: note = chr7:87229377-87230523
  misc_feature 1..1146: note = Hyper
  source 1..1146: mol_type = genomic DNA
aaattactcaaatctcgcaactatgtaaactatgaaaatgaaacaagctagttaccttttattgttcagtttaaaaaagttcttcttctttgctcctccattgcggtccccttcaagatccattccgacctgaagagaaaccgcagctcattagccaaatgcatgagcctcaggcgcgctggaggtgagactaacctctagtcccccgtcgaagccagagagcagtaagagggagcgcccgccgttgatgccccagctgctctggccgcgatgggcactgcaggggctttcctgtgcgcggggtctccagcatctccacgaaggcagagttgggggtctggcagcgcgttctggactttgcccgccgccagtgcgattctccctcccggttccagtcgccgcggacgatgcttcctcccacccaccgcccgcgggctcagagagcaggtccccgcaccgcgcgggctgtgcgcgctccgggcaacatggtccagtgccactacggtttgggcgctgctccaggagctcctgagtctagatctaaccccacttggtccccatggacttgccagaggacttcacactatccacgcctcaagaagcccttctcccgtgaagaccaagttcaggaaatctgaaagcctgacacttgggaactgtcccatagtagctcccagctttgcgtgcccctacctcgcgctccttggaacggccaccaagacgtgaaattttggaagaagatactccgactttagtggaaagacctaaaggaaacgaacagcggcctctgcttctttgagcttggaagagccgctactcgaatgagctcaggcttcctgtggcaaagagagcgaagcggctgtgctcagcccacgccccggcgctgttcctgcccagccaatcagcctcaccacagatgactgctcccggcccggattgactgaatgctgattcctcgagaaactgcgaaacaggttgaatttccaggaggaatgttctggcttccgttgcacctctctagaaagggcaagtagagaaacgcgcatcagctgaatcattggggacatttcaacttatgtagacacgtctttcaaagttcacataagtcttcatatccatataactacaggacgtagttaagggaaa

SEQ ID NO: 127959 - DNA, 983 bp, Homo sapiens
  misc_feature 1..983: note = chr7:87256912-87257895
  misc_feature 1..983: note = Hyper
  source 1..983: mol_type = genomic DNA
ctcctgcaggtaaaacggtgggtagtgagaagctctaggaagggggcgcttccgaacacgcgcgtcgaggagggcgttccaggactctgagggagcagcccagctggaccgaggccgcgtcgttcctgggcttactattcccagacccggactcccgattccggagtcacggcccaggacgcgaaaagactctacactggcaccacgctcctccttaggcgggccgtcagtcccgggtgcgggctgcgctggaggctgaggtgggagcgacatggtgtggaggggcaagaaatgtcggcactagacgcgccaagaaggagattctacgagcaattcccccctcgggccattgtgttgctgtttattagcccctgggagggcgtcaggacaaaaggaaccctcctcccttcttagtacttaggcccaaggtcgggtgtgggagccggcgcgctgctttctaggcaggcactgaagctacggcagccacgcaaataggtatcagccgttaaagcttggctacaggcaaggggggggcaataggcccctggcgctgtggggccccgcatcccacaatccccgcggctagcctgtgtggctactggcggcagctagcgggctgcgaaagcgagcccagcgtccttgacagcagcccacgcgtcggggcggggcttgagcccgctgctttaaaaggtccgcgcggccggccccgcccctctggtgccgcgattggatccggcgggggtagcgttgatttgataggcgcagagagggtggggctgcgcacgcgaggccgggggccttgccgctgcctcccgggctggggcacgagtggctgcggagtgtgggtggttgggcgtgaggggccgacgggctcgcgcgcgcgccgtctgctgaggtccctcgggaaggaggagagcgcctgacgccgacccgcaggcgcagcccggcagtcggcggcgcgccgagggcggaggtggtgcgtg

SEQ ID NO: 127960 - DNA, 443 bp, Homo sapiens; identical to SEQ ID NO: 98149
  misc_feature 1..443: note = chr7:87257955-87258398
  misc_feature 1..443: note = Hyper
  source 1..443: mol_type = genomic DNA

SEQ ID NO: 127961 - DNA, 30 bp, Homo sapiens; identical to SEQ ID NO: 98150
  misc_feature 1..30: note = chr7:87564329-87564359
  misc_feature 1..30: note = Hyper
  source 1..30: mol_type = genomic DNA

SEQ ID NO: 127962 - DNA, 49 bp, Homo sapiens; identical to SEQ ID NO: 98151
  misc_feature 1..49: note = chr7:87564603-87564652
  misc_feature 1..49: note = Hyper
  source 1..49: mol_type = genomic DNA

SEQ ID NO: 127963 - DNA, 30 bp, Homo sapiens; identical to SEQ ID NO: 98152
  misc_feature 1..30: note = chr7:87850928-87850958
  misc_feature 1..30: note = Hypo
  source 1..30: mol_type = genomic DNA

SEQ ID NO: 127964 - DNA, 86 bp, Homo sapiens; identical to SEQ ID NO: 98153
  misc_feature 1..86: note = chr7:87936120-87936206
  misc_feature 1..86: note = Hyper
  source 1..86: mol_type = genomic DNA

SEQ ID NO: 127965 - DNA, 58 bp, Homo sapiens; identical to SEQ ID NO: 98154
  misc_feature 1..58: note = chr7:88387729-88387787
  misc_feature 1..58: note = Hyper
  source 1..58: mol_type = genomic DNA

SEQ ID NO: 127966 - DNA, 42 bp, Homo sapiens; identical to SEQ ID NO: 98155
  misc_feature 1..42: note = chr7:88387989-88388031
  misc_feature 1..42: note = Hyper
  source 1..42: mol_type = genomic DNA

SEQ ID NO: 127967 - DNA, 1014 bp, Homo sapiens
  misc_feature 1..1014: note = chr7:88388282-88389296
  misc_feature 1..1014: note = Hyper
  source 1..1014: mol_type = genomic DNA
gctcattcttgcaaccggctggggagctgttgcttctgccaacgccgccgtcagccagagcgctgaagaaaagctgaaggccagcaggcaacgaaagagtaaagaaaacgccctcctcctgcccatctcctccaccacagcctccccagtcctcccaggtgactcccaaacagtagaaagttggctcagagatagggcagaagaaccggggggctgggcggctgaggccgggaggtgggagaggcgggtcctgcagccccgagagccccccgcggctgcagcggcagctgtcacctcctggcctcgccccacagcacacctgagcctcctgggcagccccgagcccacagctcccagcagaggcgctaactgccctcctcaagcacaggtcgccgcgtccccaactccctgtcctcaccccggcccgcccgtctcctcctccgccctctcccgactgcagcgggggcagcgctttggcgctcccaaggactccccgccactctccccacaaagcagcggcggtggcggcggctgctgctggatcttcacactgcagccagcagcccaggacgcccccggccggacgatgggtacccgcgcctgagcatcccccgggcaggcgccaggcgcgaaggcagggggcgggaggaaaggggcgggggaattcctgattccctggtggaccctggaagttgtccttaaataaatatatcgctggcccgcggttgagcagccacctcgtcagagcagcatgtggactggctcgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagttgagactctgcgcctccgcccggacccacatggct

SEQ ID NO: 127968 - DNA, 552 bp, Homo sapiens
  misc_feature 1..552: note = chr7:89748011-89748563
  misc_feature 1..552: note = Hyper
  source 1..552: mol_type = genomic DNA
cgggcactgactgtccgatacctcagcgatcgtaggagagcagagacgtccctcatgccgggcgcaccaccggcgggccggcggttccgttggcttccctgacatacttcctacagtcatttctttcagctgagatcttcccctttaatacctcgttaattaacgtgtaaccttttggttaaaatgtcagagctaagactaaatctgaagaaaagaatgaaaccaccgtaagttcttcagactcagtcgtcagcaaggttatggcccgaagccgtgcagaggcggcgcgcggggaagctactggcagagctgtgcgcactgggggtgctgcaggcgctggggagagtgtggagaggctgcgtggagctgcgcgctcggggtgggggctgcactcccaatgaagcgcgtgaagggcaagcggtgatgggttctgcgccagtggggctgggagcgtgtcgggggctgtacgtggggctgcgcgcaaggtgagaactgcgcatctaggcttggggactgcgcgcaccaaaggcttgcaggcgctggggagggtgg

SEQ ID NO: 127969 - DNA, 41 bp, Homo sapiens; identical to SEQ ID NO: 98162
  misc_feature 1..41: note = chr7:89748925-89748966
  misc_feature 1..41: note = Hyper
  source 1..41: mol_type = genomic DNA

SEQ ID NO: 127970 - DNA, 239 bp, Homo sapiens
  misc_feature 1..239: note = chr7:89841157-89841396
  misc_feature 1..239: note = Hyper
  source 1..239: mol_type = genomic DNA
tcccctggctgttcgcgatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggtgagcgggtcggggaggagcgcgaaagaaggtagcg

SEQ ID NO: 127971 - DNA, 539 bp, Homo sapiens; identical to SEQ ID NO: 31364
  misc_feature 1..539: note = chr7:89950183-89950722
  misc_feature 1..539: note = Hyper
  source 1..539: mol_type = genomic DNA

SEQ ID NO: 127972 - DNA, 312 bp, Homo sapiens; identical to SEQ ID NO: 98166
  misc_feature 1..312: note = chr7:90225745-90226057
  misc_feature 1..312: note = Hyper
  source 1..312: mol_type = genomic DNA

SEQ ID NO: 127973 - DNA, 478 bp, Homo sapiens
  misc_feature 1..478: note = chr7:90226268-90226746
  misc_feature 1..478: note = Hyper
  source 1..478: mol_type = genomic DNA
ggttctcccctcctccgccactagtgctcgccctttcgcgcgcgtgggggacgggcgaggggacccctcggcccccaccgcgcaaggggctgcgcggctgcttgggccacttgttattttttgcgcacaggcttggatattgggcgtttagtcagtaatttagctttggaaattggtgaaacgttagactgtgccctggtattgtttaacgtatccaacctaaagggaagtgggacagttaccttgggacctattgttcggtacttcgggtcctggaaagcgagatttgggtgttcagtctcgaggtctctgaatcttcccgctgctggagagaaatgcgcgctgtggagttgtctggacatttaggaatgtctctcgaacttgttccatttaatagagctcaggggctgttgtctttaaaccaaacaacaaaccaactgaccaacagtgtttaggacagtgacgaataaatgcatgt

SEQ ID NO: 127974 - DNA, 76 bp, Homo sapiens; identical to SEQ ID NO: 98169
  misc_feature 1..76: note = chr7:90269559-90269635
  misc_feature 1..76: note = Hypo
  source 1..76: mol_type = genomic DNA

SEQ ID NO: 127975 - DNA, 146 bp, Homo sapiens; identical to SEQ ID NO: 98170
  misc_feature 1..146: note = chr7:90558629-90558775
  misc_feature 1..146: note = Hypo
  source 1..146: mol_type = genomic DNA

SEQ ID NO: 127976 - DNA, 30 bp, Homo sapiens; identical to SEQ ID NO: 98171
  misc_feature 1..30: note = chr7:90720178-90720208
  misc_feature 1..30: note = Hypo
  source 1..30: mol_type = genomic DNA

SEQ ID NO: 127977 - DNA, 220 bp, Homo sapiens
  misc_feature 1..220: note = chr7:90894938-90895158
  misc_feature 1..220: note = Hyper
  source 1..220: mol_type = genomic DNA
cagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacc

SEQ ID NO: 127978 - DNA, 45 bp, Homo sapiens; identical to SEQ ID NO: 98175
  misc_feature 1..45: note = chr7:91510048-91510093
  misc_feature 1..45: note = Hyper
  source 1..45: mol_type = genomic DNA

SEQ ID NO: 127979 - DNA, 48 bp, Homo sapiens; identical to SEQ ID NO: 98176
  misc_feature 1..48: note = chr7:91510834-91510882
  misc_feature 1..48: note = Hypo
  source 1..48: mol_type = genomic DNA

SEQ ID NO: 127980 - DNA, 467 bp, Homo sapiens; identical to SEQ ID NO: 98178
  misc_feature 1..467: note = chr7:91808202-91808669
  misc_feature 1..467: note = Hyper
  source 1..467: mol_type = genomic DNA

SEQ ID NO: 127981 - DNA, 30 bp, Homo sapiens; identical to SEQ ID NO: 98179
  misc_feature 1..30: note = chr7:91889676-91889706
  misc_feature 1..30: note = Hypo
  source 1..30: mol_type = genomic DNA

SEQ ID NO: 127982 - DNA, 25 bp, Homo sapiens
  misc_feature 1..25: note = chr7:92076443-92076468
  misc_feature 1..25: note = Hypo
  source 1..25: mol_type = genomic DNA
tgagccaccacgccagacctggatt

SEQ ID NO: 127983 - DNA, 30 bp, Homo sapiens; identical to SEQ ID NO: 98182
  misc_feature 1..30: note = chr7:92439285-92439315
  misc_feature 1..30: note = Hyper
  source 1..30: mol_type = genomic DNA

SEQ ID NO: 127984 - DNA, 329 bp, Homo sapiens
  misc_feature 1..329: note = chr7:92466152-92466481
  misc_feature 1..329: note = Hyper
  source 1..329: mol_type = genomic DNA
aaattaaagccttccggagagaaatgaggcggccgagtcccggcagtgctccgagctccgggctccctagctcccttctacgagtcgggggctagaagggcgcggtgggggtgggggtgggggggagagttaaatgaaaatttccggctttcgctgaaactgtagtagggggatcctgcgactaaaataagcggcattagtgggagagagtgggacgtgtcgtcgggagtcggcggagtttccaaacccagggtcgcccagagttggggttttgacagggtgaagcggggggcatcctcactgtgtgacgtggacggatgggaaaaaca

SEQ ID NO: 127985 - DNA, 464 bp, Homo sapiens; identical to SEQ ID NO: 98184
  misc_feature 1..464: note = chr7:92689310-92689774
  misc_feature 1..464: note = Hypo
  source 1..464: mol_type = genomic DNA

SEQ ID NO: 127986 - DNA, 30 bp, Homo sapiens; identical to SEQ ID NO: 98185
  misc_feature 1..30: note = chr7:92731846-92731876
  misc_feature 1..30: note = Hypo
  source 1..30: mol_type = genomic DNA

SEQ ID NO: 127987 - DNA, 30 bp, Homo sapiens; identical to SEQ ID NO: 98186
  misc_feature 1..30: note = chr7:92732475-92732505
  misc_feature 1..30: note = Hypo
  source 1..30: mol_type = genomic DNA

SEQ ID NO: 127988 - DNA, 30 bp, Homo sapiens; identical to SEQ ID NO: 41367
  misc_feature 1..30: note = chr7:93055830-93055860
  misc_feature 1..30: note = Hypo
  source 1..30: mol_type = genomic DNA

SEQ ID NO: 127989 - DNA, 235 bp, Homo sapiens; identical to SEQ ID NO: 98188
  misc_feature 1..235: note = chr7:93203561-93203796
  misc_feature 1..235: note = Hyper
  source 1..235: mol_type = genomic DNA

SEQ ID NO: 127990 - DNA, 897 bp, Homo sapiens
  misc_feature 1..897: note = chr7:93204217-93205114
  misc_feature 1..897: note = Hyper
  source 1..897: mol_type = genomic DNA
cgagctggtgagctccgtgcgcctcgcgccagccccagtcgccccggcccgcgagtggggctgcgctcgcggctgctgtctcgctccagtcagggctggggctcaccctgcgagtccgggagactaaagcgccgcgtaaacacaggaagcaggcgagggacccgagttagaccttgagtagggagggagaggggggcgacagtctggactgggagacagctttctgggagccctgtcccctccccggagaatgcaaattccggagggaggtgagtttccacaagaaccttatcccagagacattgtgaccctggcttcttcagccgccactccggggacagcactagggagcctgtggagggagggtcggtagtgggctaggtagtgaaagtggggtgaggacgtgggaagacggctggctaagagctggggtgctaaaaggaaaaaagtgctgagaggaaggagatgagaagagacaccttgggggtcaggcaagccctgggaaagcgtccggagttgggcggctgtaggctggaggcataacttggatttggagaaagagtgccctccgtgtaggggactgctggtgggcacagtgttttagggtgaatgaaaacagagaggatggcgagggaagacggggatatggggtgcctgacttggtgccggacactgcgactcctcttctttccccctaaagccctcgatgtcagcaggagtccgggacaatccaataccaggcggggcgcagcggaggctggcaggcacgccctgggaggcaggcaagttgattccaaggacgagtcaccctcaacctcttttagcccacaactgggtggatcaaggcaggagccaacacttttttccctaactctgtttaggcggtgttggactaag

SEQ ID NO: 127991 - DNA, 146 bp, Homo sapiens; identical to SEQ ID NO: 98192
  misc_feature 1..146: note = chr7:93511549-93511695
  misc_feature 1..146: note = Hypo
  source 1..146: mol_type = genomic DNA

SEQ ID NO: 127992 - DNA, 1262 bp, Homo sapiens
  misc_feature 1..1262: note = chr7:93519204-93520466
  misc_feature 1..1262: note = Hyper
  source 1..1262: mol_type = genomic DNA
atctttccctgagtccgcacaggcactgaattatgatcaatgtcagttgggagacaggaaatgtgttagtggttgtaaatttgtgattacttttaagaaactgaaaaccatgaggtttgcttaacacttgagaaaacccaggctaaaacttcctgtagaaagcgagacgtgggaaactggcgaagctgctaccagccgccggcgcaaggagcgcgagagtcctgggtgcgcgcagggcacttactttctatcctccagcaagcatcgtcgcaagcctcccaggtgtagaaattgttggcgttgccctcgcagcccccgtacaggaactggcggcagctctgcgtgtacctgtcgtagtagtaacggagaagtagggcccggcagggtccgtagtctaggggcaggagacagatctccgcgttatttcctgaagaaggggcagaaggagagcaaaagagagggaaagtggtcaggcgtagctcctaggaggaaagaacatcccggggagttctgtccccttccgagcggaggggcctctgcagagaaagtgcaaacttgggagcgagtcccccctgccagcggagcgcgcggcagggacctggagaaagcgaggcttggagggcgcctacacggggccccatggcccgctgcgccctctccgccggttggggagagaagctcctggagcggccagatacctgttggctcctgagcagcatcgcccagtgcagcctccgtcaggaaaagcagcagaatcgacagccccagggggcgagcggggtccatggtgcagggggtcgggcggcccgctgggcaaggcgtccgagaaagcgcctggcgggaggaggtgcgcggctttctgctccaggcggcccgggtgcccgctttatgcggggcgagcgtccggccgacccccgccggggcggagcctgaggggtggctgattcatgcacggggactgtcaccccgccgcccccgcgctgcaaactgtgtaagagggagaggaattccccgccaagttgaaaagttgaacctgcctcccaaactttctcctgtagtccagacggggacgccctgagggagcgtttgtgtcagtaatgggaaatctgcaagctagacggaaatgacctgctagtgattgcgctgtaaagaagccggaatccacctcttgaaggcatgaagttcaggtatttgaaaggctggtggagagaaagtgcggagttcttgggtcagagcggagcgggattcgttgcaatggacct

SEQ ID NO: 127993 - DNA, 28 bp, Homo sapiens
  misc_feature 1..28: note = chr7:93520878-93520906
  misc_feature 1..28: note = Hypo
  source 1..28: mol_type = genomic DNA
actccagtctgggcggcagagtggaact

SEQ ID NO: 127994 - DNA, 534 bp, Homo sapiens; identical to SEQ ID NO: 98197
  misc_feature 1..534: note = chr7:93550996-93551530
  misc_feature 1..534: note = Hyper
  source 1..534: mol_type = genomic DNA

SEQ ID NO: 127995 - DNA, 33 bp, Homo sapiens; identical to SEQ ID NO: 98198
  misc_feature 1..33: note = chr7:93605811-93605844
  misc_feature 1..33: note = Hypo
  source 1..33: mol_type = genomic DNA

SEQ ID NO: 127996 - DNA, 37 bp, Homo sapiens; identical to SEQ ID NO: 98199
  misc_feature 1..37: note = chr7:93641681-93641718
  misc_feature 1..37: note = Hypo
  source 1..37: mol_type = genomic DNA

SEQ ID NO: 127997 - DNA, 30 bp, Homo sapiens; identical to SEQ ID NO: 31379
  misc_feature 1..30: note = chr7:94024050-94024080
  misc_feature 1..30: note = Hyper
  source 1..30: mol_type = genomic DNA

SEQ ID NO: 127998 - DNA, 39 bp, Homo sapiens; identical to SEQ ID NO: 98201
  misc_feature 1..39: note = chr7:94138061-94138100
  misc_feature 1..39: note = Hypo
  source 1..39: mol_type = genomic DNA

SEQ ID NO: 127999 - DNA, 783 bp, Homo sapiens; identical to SEQ ID NO: 98202
  misc_feature 1..783: note = chr7:94284364-94285147
  misc_feature 1..783: note = Hyper
  source 1..783: mol_type = genomic DNA

SEQ ID NO: 128000 - DNA, 751 bp, Homo sapiens; identical to SEQ ID NO: 98203
  misc_feature 1..751: note = chr7:94536847-94537598
  misc_feature 1..751: note = Hyper
  source 1..751: mol_type = genomic DNA

SEQ ID NO: 128001 - DNA, 30 bp, Homo sapiens; identical to SEQ ID NO: 98204
  misc_feature 1..30: note = chr7:94537877-94537907
  misc_feature 1..30: note = Hyper
  source 1..30: mol_type = genomic DNA

SEQ ID NO: 128002 - DNA, 385 bp, Homo sapiens; identical to SEQ ID NO: 98205
  misc_feature 1..385: note = chr7:95225822-95226207
  misc_feature 1..385: note = Hyper
  source 1..385: mol_type = genomic DNA

SEQ ID NO: 128003 - DNA, 48 bp, Homo sapiens; identical to SEQ ID NO: 98206
  misc_feature 1..48: note = chr7:95401676-95401724
  misc_feature 1..48: note = Hyper
  source 1..48: mol_type = genomic DNA

SEQ ID NO: 128004 - DNA, 420 bp, Homo sapiens; identical to SEQ ID NO: 98207
  misc_feature 1..420: note = chr7:95402025-95402445
  misc_feature 1..420: note = Hyper
  source 1..420: mol_type = genomic DNA

SEQ ID NO: 128005 - DNA, 30 bp, Homo sapiens; identical to SEQ ID NO: 98210
  misc_feature 1..30: note = chr7:96619573-96619603
  misc_feature 1..30: note = Hyper
  source 1..30: mol_type = genomic DNA

SEQ ID NO: 128006 - DNA, 634 bp, Homo sapiens; identical to SEQ ID NO: 98211
  misc_feature 1..634: note = chr7:96621715-96622349
  misc_feature 1..634: note = Hyper
  source 1..634: mol_type = genomic DNA

SEQ ID NO: 128007 - DNA, 642 bp, Homo sapiens; identical to SEQ ID NO: 98212
  misc_feature 1..642: note = chr7:96625570-96626212
  misc_feature 1..642: note = Hyper
  source 1..642: mol_type = genomic DNA

SEQ ID NO: 128008 - DNA, 126 bp, Homo sapiens; identical to SEQ ID NO: 98213
  misc_feature 1..126: note = chr7:96627308-96627434
  misc_feature 1..126: note = Hyper
  source 1..126: mol_type = genomic DNA

SEQ ID NO: 128009 - DNA, 36 bp, Homo sapiens; identical to SEQ ID NO: 98214
  misc_feature 1..36: note = chr7:96628041-96628077
  misc_feature 1..36: note = Hyper
  source 1..36: mol_type = genomic DNA

SEQ ID NO: 128010 - DNA, 144 bp, Homo sapiens; identical to SEQ ID NO: 98215
  misc_feature 1..144: note = chr7:96631691-96631835
  misc_feature 1..144: note = Hyper
  source 1..144: mol_type = genomic DNA

SEQ ID NO: 128011 - DNA, 30 bp, Homo sapiens; identical to SEQ ID NO: 98216
  misc_feature 1..30: note = chr7:96632234-96632264
  misc_feature 1..30: note = Hyper
  source 1..30: mol_type = genomic DNA

SEQ ID NO: 128012 - DNA, 30 bp, Homo sapiens; identical to SEQ ID NO: 98217
  misc_feature 1..30: note = chr7:96632789-96632819
  misc_feature 1..30: note = Hyper
  source 1..30: mol_type = genomic DNA

SEQ ID NO: 128013 - DNA, 500 bp, Homo sapiens; identical to SEQ ID NO: 98218
  misc_feature 1..500: note = chr7:96633044-96633544
  misc_feature 1..500: note = Hyper
  source 1..500: mol_type = genomic DNA

SEQ ID NO: 128014 - DNA, 50 bp, Homo sapiens; identical to SEQ ID NO: 31392
  misc_feature 1..50: note = chr7:96634276-96634326
  misc_feature 1..50: note = Hyper
  source 1..50: mol_type = genomic DNA

SEQ ID NO: 128015 - DNA, 267 bp, Homo sapiens; identical to SEQ ID NO: 98220
  misc_feature 1..267: note = chr7:96634652-96634919
  misc_feature 1..267: note = Hyper
  source 1..267: mol_type = genomic DNA

SEQ ID NO: 128016 - DNA, 1603 bp, Homo sapiens
  misc_feature 1..1603: note = chr7:96635204-96636807
  misc_feature 1..1603: note = Hyper
  source 1..1603: mol_type = genomic DNA
ctgcagaggggagagcggcgcgagccaagtgggggagggtggaggaaacccgggagaaggctttctccagcccccaaagtttttgatgatgaccatgactacgatggctgacggcttggaaggccaggactcgtccaaatccgccttcatggagttcgggcagcagcagcagcagcagcagcaacagcagcagcagcagcagcagcaacagcaacagccgccgccgccgccgccgccgccgccgcagccgcactcgcagcagagctccccggccatggcaggcgcgcactaccctctgcactgcctgcactcggcggcggcggcggcagcggccggctcgcaccaccaccaccaccaccagcaccaccaccacggctcgccctacgcgtcgggcggagggaactcctacaaccaccgctcgctcgccgcctacccctacatgagccactcgcagcacagcccttacctccagtcctaccacaacagcagcgcagccgcccagacgcgaggggacgacacaggtgagaggccgctggggcagctcgcttctcccgcctcccgactgccccctaccccgcccgcccgctcacttcctcgacgcccgggcctccgccggccccctcccccaggcggccccgcgcgcccttggccgggccccgtgcgcgcccgctcgcctggcgcctgcctgccggcctctcccagccgggccccttcccgccgccgcggaccctcagcttccgacgcgcagttcgggctgagtcccgggcccggcgcaggcttcgttcgacgagttagtccacactgcgctctccagcctcctgggtctgtgcgcccttttccttgctccttccctccaggctgtaacccacgtttgacccggctggggacatttctgggccggaactggggagcgtgttttgcttcccagcccacgctgggcaggcagtggcctactttgcgtggggcgccccgtgctcctcagtgactcggagggaagctggcctggctttcgctctggttaaactagtaacagtcaggctctttccagtgggctttaaagtgtccctcaccttcatccctgaccgggccccctatctagcttttcgctacagtgttggctgctcctttgttcgtggaggggaagcaaagaacctcgggctgatggttctcagcacccgagggggacaaagttgccgtgagaggcgcagcctgctcgtgggctggtctgagctgttggttgtgttttgtttgaggatttggtcctcctcaggagagtcatttcaaaacatgccgaggatgcttgatgcactgagcttggagctggtgacatcaagtcaactggccgcgtaaacacctgggtggctcaagcacagcttcaggtactgttaagccgggcacaggggccccgctccgcccggacagctgccgccttgctgcgctgcgcaccccagagagcctccggcaccgcctccgctgcggcaaagcgggctgtttgtctgagggcctctggcgctcccttggcccagacgctgcacattgttcgggccagggactgggtcaaggagattacgcagacgctgggagcacacgggcagagtggacc

SEQ ID NO: 128017 - DNA, 312 bp, Homo sapiens
  misc_feature 1..312: note = chr7:96641441-96641753
  misc_feature 1..312: note = Hyper
  source 1..312: mol_type = genomic DNA
tttttcatgtagcccgctgattacagcgtttttaccgtcaaagataattacctgtaattttcttccacttttaatactaaaaagccatctttatttagattcaggaacaggaaaggcgaaacaaaagagggaaattattctgttattcatacacaaattgcagagacgtaggacctaaaattgaaaattaaccaaaattataatgctgaaaagaatggaagaggctgcagaagtacagctggtagtggggctttgctgaattattcaaattacgttagggagaatgctaccatacatcgaaaccaacactaa

SEQ ID NO: 128018 - DNA, 106 bp, Homo sapiens; identical to SEQ ID NO: 98226
  misc_feature 1..106: note = chr7:96642021-96642127
  misc_feature 1..106: note = Hyper
  source 1..106: mol_type = genomic DNA

SEQ ID NO: 128019 - DNA, 60 bp, Homo sapiens; identical to SEQ ID NO: 98227
  misc_feature 1..60: note = chr7:96642748-96642808
  misc_feature 1..60: note = Hyper
  source 1..60: mol_type = genomic DNA

SEQ ID NO: 128020 - DNA, 1720 bp, Homo sapiens; identical to SEQ ID NO: 98228
  misc_feature 1..1720: note = chr7:96645617-96647337
  misc_feature 1..1720: note = Hyper
  source 1..1720: mol_type = genomic DNA

SEQ ID NO: 128021 - DNA, 769 bp, Homo sapiens; identical to SEQ ID NO: 98229
  misc_feature 1..769: note = chr7:96647540-96648309
  misc_feature 1..769: note = Hyper
  source 1..769: mol_type = genomic DNA

SEQ ID NO: 128022 - DNA, 1456 bp, Homo sapiens
  misc_feature 1..1456: note = chr7:96650046-96651502
  misc_feature 1..1456: note = Hyper
  source 1..1456: mol_type = genomic DNA
tctaatagagtgtcccggaggccagcgccagcgggtgctgtaaggagcccggcggcggcaggtgggaattgattgagctggctgcacttgtgtaccaggatgcagagttctccaggtagctggacgctggggactggttggaggtcggagggtgggcatgagggtggtggctgagcgagcgggacgagccctggggctcccacaccgctggagactgcggcgagttacacgccattgggtcgctggagctgggactgtgctccgggggcatctccccgtttttcatgatcttcttgatcttggatcttttgttctgaaaccagattttcacctgagttggggaacaaaggcacacgttaccgggacactcagaggtcgcccgcgccttccccggggcggcgactggaggcatcttcggacctctgggcggcccagccctgcctggcgtctccccgccgcttgcggcctaccgccaagaagctatgccttaggcaaaccatggagctctggccccagagggcgccctggccggctcggggcgccccggcccagcgaggccacgaccccaaggcttgtcttttgtttgggctgggggtgggggacgccagcgcggcgggtgtgcgcccgagtgtcctcggcggcggcgcgcctcgtgtaagcctgcgcaggacgcgcggaacgcggcgaaggtctccaaaacaatcgcgcgagcccggcggggaaggggcgtggggcgggctacgcgcgcctgtggtcagaaaaaggagcgagctcccaacctcccgtcctactcccttcactccctctgcagctcagagaggccagaatctgactgcagctcttggcggcgactcgaacattctttatgcttccgtaggccccagctgggttggaggagtaaaaggaatgggacaatccaggaagacttctcacgtacaatagcgccccccacctcgcgacccttcggtggccgtggcctgaagctcccgtaggctcagggcacgacccttcagtttctccgctccaggcgacgttctcagccttttcttagcctgagaccaccgcgagaacaccaggccttgctcacccccgaggaggctctacattgttaagaaaaccagatagctgctctgggctgcctaggccgccctagaaataaccctccgcttgctttcaacccgcgaaattggccccacagctccggaggcccgctacggggtgggggcggggggcgcggttagtgggaggtatctccagaccgctgatgaataccatccccaccgtctcaaggcctgactcaccgagttaaagcataggggctgatgtctttgggtctgttagtttctcacgggtactgtcaaaacagctccagtcccatcgagactgaaccgcgcgacccaaccagacgtgcagctcaggcaggtctagtgcatggcagcgccgtatttacctgtgt

SEQ ID NO: 128023 - DNA, 585 bp, Homo sapiens
  misc_feature 1..585: note = chr7:96651845-96652430
  misc_feature 1..585: note = Hyper
  source 1..585: mol_type = genomic DNA
ccaaatatggaaaagcgggatagcctctgattaattcctactctgttcattcagatagtttgtgcaaagcgcttcctacaacactgctttctccttggcatctgggattcagctcttgcggtcgttgcttcttctcccggacttgtttttacgcccaccctgtgctcctccgcgtttccgcccctccccaggcttcaagaacaccagcccctccccaggcttcaaggaggtggccctgggccgtgaccctacttctgtcggcgtctgttcgggcgcccgcagaagccagactcttgggcagggaagacgctaaccgaggtctccaaagttcaaagacccacaagcaaactgctccttcacttcagcagcaagcggtcggggccgccgcagacagagggtcgattatgcaacccccataatctcgctgcagatctgcgagggcacagatgtgtctggtttcttttacaaatagacttaatatgttcttggcaaaaaaaaaaaaaaaaaaaagaaatcttccacttatgcacggaatacagagagagtgaaagaaacgtagacacctcaacccggggctctctttta

SEQ ID NO: 128024 - DNA, 30 bp, Homo sapiens; identical to SEQ ID NO: 98235
  misc_feature 1..30: note = chr7:96652891-96652921
  misc_feature 1..30: note = Hyper
  source 1..30: mol_type = genomic DNA

SEQ ID NO: 128025 - DNA, 984 bp, Homo sapiens
  misc_feature 1..984: note = chr7:96653182-96654166
  misc_feature 1..984: note = Hyper
  source 1..984: mol_type = genomic DNA
cgcaccaacccagcacgcttaccaaaattcccaagtaaccttctctttgttacgcaaacgccaggagctgcttgattctttcttctctccacccctatcccctttccagcctagccggcttcctggccgggcaagctgggaattcagcgactgaagggccttggaaggtgccggaggggagagacgctagttcgaacctccacagggctctcctactaaaaatccctaaaatgctggcccgagaaactctctttgttggagggtctgagtcctactcccttctgccgcgtgcgcccccactgccgtgaaccgctgtgacccccaatctaccaccccatctcgcgcccccagcgtcctagtcgccctgtatctgcccagccttccccctgtccatgtacctggctggttggtggcgcttgggacgcggttgtaggcgccgccgtactggtggtaggagctagcgtagctatagtcggcataagctttggctgggtagctcccggcggagccgttcacgccgtgatactgatactggtaggggttgagagctttgccataggaagccgaggtaggagagcagtagccgtgcggggctccccccgtagggctgtagtagtcagaatcggtagctgaagactcgggcaaagttggcgattcctgagacggatggtgcatagctgcggacgtctggaacggagcttggaagtcgccggatcggatgctggggacccttctgtcaaacactcctgtcatcgctcacgggcggcggcagcggctgtccttgctgttgtggcggcggcagctgccctagttggctgtggggctgctctggtctaagcagacatggctgtgggagcgagggaggaggaggaagaggaggaggagagaaggaggaggcggcggccgcggcgaggaggagactgggagtcgtgaagtctctgtctccggccggctgactgctggctgaggcgcagcacagccttg

SEQ ID NO: 128026 - DNA, 83 bp, Homo sapiens; identical to SEQ ID NO: 31408
  misc_feature 1..83: note = chr7:96656775-96656858
  misc_feature 1..83: note = Hyper
  source 1..83: mol_type = genomic DNA

SEQ ID NO: 128027 - DNA, 39 bp, Homo sapiens; identical to SEQ ID NO: 98240
  misc_feature 1..39: note = chr7:96747112-96747151
  misc_feature 1..39: note = Hyper
  source 1..39: mol_type = genomic DNA

SEQ ID NO: 128028 - DNA, 22 bp, Homo sapiens
  misc_feature 1..22: note = chr7:96968265-96968287
  misc_feature 1..22: note = Hypo
  source 1..22: mol_type = genomic DNA
gccaccgcgcctggccctattt

SEQ ID NO: 128029 - DNA, 26 bp, Homo sapiens
  misc_feature 1..26: note = chr7:97234138-97234164
  misc_feature 1..26: note = Hypo
  source 1..26: mol_type = genomic DNA
gccaccgcgcccggccaatacaatga

SEQ ID NO: 128030 - DNA, 776 bp, Homo sapiens
  misc_feature 1..776: note = chr7:97361005-97361781
  misc_feature 1..776: note = Hyper
  source 1..776: mol_type = genomic DNA
tgcaacttatcctgacgtctcgagggacggaaaagttaccgaagtccaaggaatgagtcactttgctcaaatttgatgagtaatatcaggtgtcatgaaacccagtttcgaaggagaggggagggggcgtcagatctgcagacggaagcaggccgctccggattggatggcgagacctcgattttcctaaaattgcgtcatttagaacccaattgggtccagatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcagtaagtgcccgcgcggtgctggccgcggctgcccgggtcaccccgccccgcatctgtccgaggtggccgcgctgggggcgccgctgcggcgagggacagtggggagactggcttcccaaacgccaacgcccctctttgtcttccacctgcagagtttcctggtttgaaggtgtgggttggtgggttagggggctgggggagttgggattcagggagaagagggttggagaatctttgggacgcgattctctcgcctaaccggtacaggtgagac

SEQ ID NO: 128031 - DNA, 1129 bp, Homo sapiens
  misc_feature 1..1129: note = chr7:97362187-97363316
  misc_feature 1..1129: note = Hyper
  source 1..1129: mol_type = genomic DNA
aggggcactatttcccgggttccccacgggattttgtgcccacgattcaagtttcttcccgagggctgcaccgtccggcccaggaactccctgcagtagggatgccctcccggatgagcccgagatcctcacaaggcgggaaatctcgtaagatttcatcccccaggacctgggatttcgggggctccggtccagctgcactgccctagcgtctgggcacgggcagaggagggcgcctgggtcgcgggcagcagcgggcacacgcgcgagctgcagggggattggagggccggaggctggagggaagttaatttcctgccttcacgtttgttttgcggacctgaggatgtagcttgaagtctccctttagaaactcgtaggctacaggcgctggggagcgcgcctcggaaaaacggtgaaagtcgtctgtaaagcgttgtcacccttccccaccggagccccagccccagatcccacacacctgtgtgcatttagggcggtgaggactctacaaagccggcaccgagacaagacaaagtcaggtggcggcgcagcagatgagggaaggtccccgggctgggaggaaagagcggaaagcgctcgaagcttgaagacgccgagccagctgctaactcgccctggcaggcttgcggggggcgggacgcgagttcggcggggaggggcgcagagaggcagcgcctcgggagggaccccgctcagcccgagcgtggggaaggccgcctccccacgcctcggggccggagtacagcggggggaagggctcgggttgctgggtgcctcgctctggttgccttacacgccctttgtccgtgcttttgtctcccaggaggaactgccggagccctttgagcatcttctgcagagaatcgcccggagacccaagcctcagcagttctttggattaatgggcaaacgggatgctggtgagataggcgaccgtccctaggtgtcttgggcagcccgccctgtctgctcactccttcctggagtaccccagggtctctcgctctgaatagagatttccactccaagaggggtgtaattccccaggcgcgacattggcccacaccgcactaaggcacgcacgggcccgcggggggagggaaag

SEQ ID NO: 128032 - DNA, 120 bp, Homo sapiens; identical to SEQ ID NO: 98247
  misc_feature 1..120: note = chr7:97589532-97589652
  misc_feature 1..120: note = Hypo
  source 1..120: mol_type = genomic DNA

SEQ ID NO: 128033 - DNA, 242 bp, Homo sapiens; identical to SEQ ID NO: 98248
  misc_feature 1..242: note = chr7:97591231-97591473
  misc_feature 1..242: note = Hypo
  source 1..242: mol_type = genomic DNA

SEQ ID NO: 128034 - DNA, 136 bp, Homo sapiens; identical to SEQ ID NO: 98249
  misc_feature 1..136: note = chr7:97600089-97600225
  misc_feature 1..136: note = Hypo
  source 1..136: mol_type = genomic DNA

SEQ ID NO: 128035 - DNA, 76 bp, Homo sapiens; identical to SEQ ID NO: 98250
  misc_feature 1..76: note = chr7:97600285-97600361
  misc_feature 1..76: note = Hypo
  source 1..76: mol_type = genomic DNA

SEQ ID NO: 128036 - DNA, 25 bp, Homo sapiens
  misc_feature 1..25: note = chr7:97602847-97602872
  misc_feature 1..25: note = Hypo
  source 1..25: mol_type = genomic DNA
tctccgcctgattgacggaatgaac

SEQ ID NO: 128037 - DNA, 78 bp, Homo sapiens; identical to SEQ ID NO: 98252
  misc_feature 1..78: note = chr7:97627595-97627673
  misc_feature 1..78: note = Hypo
  source 1..78: mol_type = genomic DNA

SEQ ID NO: 128038 - DNA, 151 bp, Homo sapiens; identical to SEQ ID NO: 98254
  misc_feature 1..151: note = chr7:97680597-97680748
  misc_feature 1..151: note = Hyper
  source 1..151: mol_type = genomic DNA

SEQ ID NO: 128039 - DNA, 30 bp, Homo sapiens; identical to SEQ ID NO: 98255
  misc_feature 1..30: note = chr7:97689387-97689417
  misc_feature 1..30: note = Hypo
  source 1..30: mol_type = genomic DNA

SEQ ID NO: 128040 - DNA, 30 bp, Homo sapiens; identical to SEQ ID NO: 98257
  misc_feature 1..30: note = chr7:97738118-97738148
  misc_feature 1..30: note = Hypo
  source 1..30: mol_type = genomic DNA

SEQ ID NO: 128041 - DNA, 102 bp, Homo sapiens; identical to SEQ ID NO: 98258
  misc_feature 1..102: note = chr7:97797696-97797798
  misc_feature 1..102: note = Hypo
  source 1..102: mol_type = genomic DNA

SEQ ID NO: 128042 - DNA, 30 bp, Homo sapiens; identical to SEQ ID NO: 41372
  misc_feature 1..30: note = chr7:97804272-97804302
  misc_feature 1..30: note = Hypo
  source 1..30: mol_type = genomic DNA

SEQ ID NO: 128043 - DNA, 30 bp, Homo sapiens; identical to SEQ ID NO: 41373
  misc_feature 1..30: note = chr7:97807742-97807772
  misc_feature 1..30: note = Hypo
  source 1..30: mol_type = genomic DNA

SEQ ID NO: 128044 - DNA, 134 bp, Homo sapiens; identical to SEQ ID NO: 98261
  misc_feature 1..134: note = chr7:97834167-97834301
  misc_feature 1..134: note = Hypo
  source 1..134: mol_type = genomic DNA

SEQ ID NO: 128045 - DNA, 41 bp, Homo sapiens; identical to SEQ ID NO: 98262
  misc_feature 1..41: note = chr7:97839783-97839824
  misc_feature 1..41: note = Hypo
  source 1..41: mol_type = genomic DNA

SEQ ID NO: 128046 - DNA, 30 bp, Homo sapiens; identical to SEQ ID NO: 98263
  misc_feature 1..30: note = chr7:97844525-97844555
  misc_feature 1..30: note = Hypo
  source 1..30: mol_type = genomic DNA

SEQ ID NO: 128047 - DNA, 144 bp, Homo sapiens; identical to SEQ ID NO: 98264
  misc_feature 1..144: note = chr7:97844894-97845038
  misc_feature 1..144: note = Hypo
  source 1..144: mol_type = genomic DNA

SEQ ID NO: 128048 - DNA, 57 bp, Homo sapiens; identical to SEQ ID NO: 98265
  misc_feature 1..57: note = chr7:97846981-97847038
  misc_feature 1..57: note = Hypo
  source 1..57: mol_type = genomic DNA

SEQ ID NO: 128049 - DNA, 87 bp, Homo sapiens; identical to SEQ ID NO: 98266
  misc_feature 1..87: note = chr7:97852229-97852316
  misc_feature 1..87: note = Hypo
  source 1..87: mol_type = genomic DNA

SEQ ID NO: 128050 - DNA, 30 bp, Homo sapiens; identical to SEQ ID NO: 98267
  misc_feature 1..30: note = chr7:97852802-97852832
  misc_feature 1..30: note = Hypo
  source 1..30: mol_type = genomic DNA

SEQ ID NO: 128051 - DNA, 31 bp, Homo sapiens; identical to SEQ ID NO: 98268
  misc_feature 1..31: note = chr7:97869134-97869165
  misc_feature 1..31: note = Hypo
  source 1..31: mol_type = genomic DNA

SEQ ID NO: 128052 - DNA, 330 bp, Homo sapiens; identical to SEQ ID NO: 98269
  misc_feature 1..330: note = chr7:97869405-97869735
  misc_feature 1..330: note = Hypo
  source 1..330: mol_type = genomic DNA

SEQ ID NO: 128053 - DNA, 42 bp, Homo sapiens; identical to SEQ ID NO: 41377
  misc_feature 1..42: note = chr7:97882348-97882390
  misc_feature 1..42: note = Hypo
  source 1..42: mol_type = genomic DNA

SEQ ID NO: 128054 - DNA, 77 bp, Homo sapiens; identical to SEQ ID NO: 98272
  misc_feature 1..77: note = chr7:97899729-97899806
  misc_feature 1..77: note = Hypo
  source 1..77: mol_type = genomic DNA

SEQ ID NO: 128055 - DNA, 30 bp, Homo sapiens; identical to SEQ ID NO: 98273
  misc_feature 1..30: note = chr7:97917070-97917100
  misc_feature 1..30: note = Hypo
  source 1..30: mol_type = genomic DNA

SEQ ID NO: 128056 - DNA, 65 bp, Homo sapiens; identical to SEQ ID NO: 98274
  misc_feature 1..65: note = chr7:97925156-97925221
  misc_feature 1..65: note = Hypo
  source 1..65: mol_type = genomic DNA

SEQ ID NO: 128057 - DNA, 30 bp, Homo sapiens; identical to SEQ ID NO: 98275
  misc_feature 1..30: note = chr7:98088677-98088707
  misc_feature 1..30: note = Hypo
  source 1..30: mol_type = genomic DNA

SEQ ID NO: 128058 - DNA, 22 bp, Homo sapiens
  misc_feature 1..22: note = chr7:98121341-98121363
  misc_feature 1..22: note = Hypo
  source 1..22: mol_type = genomic DNA
agaaattaacagggccgggcgc

SEQ ID NO: 128059 - DNA, 62 bp, Homo sapiens; identical to SEQ ID NO: 98277
  misc_feature 1..62: note = chr7:98121881-98121943
  misc_feature 1..62: note = Hypo
  source 1..62: mol_type = genomic DNA

SEQ ID NO: 128060 - DNA, 30 bp, Homo sapiens; identical to SEQ ID NO: 98278
  misc_feature 1..30: note = chr7:98122148-98122178
  misc_feature 1..30: note = Hypo
  source 1..30: mol_type = genomic DNA

SEQ ID NO: 128061 - DNA, 198 bp, Homo sapiens; identical to SEQ ID NO: 15009
  misc_feature 1..198: note = chr7:98183080-98183278
  misc_feature 1..198: note = Hypo
  source 1..198: mol_type = genomic DNA

SEQ ID NO: 128062 - DNA, 2043 bp, Homo sapiens
  misc_feature 1..2043: note = chr7:98245805-98247848
  misc_feature 1..2043: note = Hyper
  source 1..2043: mol_type = genomic DNA
cgcccagggggcagtcgatgaacacgcgcgcgagggctctgcgagtggcctcgtgactttgtccctaactccgggtgtcccctccttcccatcagcgtccggcgcctggtcctggtcccggtccccgaggcccccgggattcttcccgagcgttttccgagttggcgcggggggtggaggcggggccatggagcgcgtcccggggaccgttgcatccggaggcggccgtcgtgcggctccttcccgcctcgagagtgaggtggccgggccttgacgagaaggcccacgcctgccgcgggggtggctcgcgatggcagtcggggttcgagtcccgcctggggggctgctcctgctggagaaaacgcctccctgagggcggcggcaaacgcgcagcgaggccccgtgccgcgccagaagccaccctgagaaaggggcaccgggacaccgaggggttcccactttctcctcagcctgtgacgcccgcgtcctcgggtgggttcgaggggcgcctgggcacggccagccgaggctctcgagagccccagtgtcgttttccacctcaggcctcctttcctgaggcagagcccgggacctcgcgctctcgcctcaggctccggcccacgctcccgcccggccgccaggcgcgcaacggaaagcgcccccgccccgccccgctccgcccactgcgtgacgcgcacccggccgagccaatcagagctcgtggcgcgcgccccacacgccggccccctccgcccctcagcttaagaaagggcgcgcggacccggcaggccagagtgccgagcagcgcggtgggtgcggctgtgagacggcaggagacttctgccccgcggtgcacgcgaccctcgagacgacagcgcggctactgccagcagcgaaggcgcctcccgcggagcgccccgacggcgcccgctcgcccatgccgagctgagcgcggcagcggcggcgggatgctggcgctgctggccgccagcgtggcgctcgccgtggccgctggggcccaggacagcccggcgcccggtagccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcgggaccccggccacgtcgtggagcagctcagccgctcgctgcagaccctcaaggaccgcctggagagcctcgaggtagcggcccgcggggagcgcgggggacctggaatggggacgctcccgagtcgggggcggaagactcgggaggatggggaaagggggcctggccctggggagggtgtgatcgtccgtgggggtgagctggacttgagggtgaaaggcggggatctagatcctgctcgggaactcccctgcgtggtatcccttcccacaccgctgctcttgctggaaggaaacgtttaaattccacccccgcgcgtcgggactgccagcgggatccgccgagcacttcccgaggtccgggctagcgaacccagacggccaagccgcgggcgccaaatacccggggacgcggtagcctctatcctcttgcaaatctccaaatctccgcgagccgggatgcgctcccgcaggccgtgcgggttgctgcgaggctgccgcgggaggtcagctgccccgggcatgtggtgtttctttctttaaatcaggtcaggctgagctagagggggcggaagtctgggggcggaggtcgcagggaggcgagcgcagggggtcaccggcgaccccagagcgcgcattagaggggcaacctctggttaacttcaaagactcccgtgtctgcaagttggaccattttaaggtgctcttccggattgcttcaggg

SEQ ID NO: 128063 - DNA, 109 bp, Homo sapiens; identical to SEQ ID NO: 98284
  misc_feature 1..109: note = chr7:98635920-98636029
  misc_feature 1..109: note = Hypo
  source 1..109: mol_type = genomic DNA

SEQ ID NO: 128064 - DNA, 30 bp, Homo sapiens; identical to SEQ ID NO: 98285
  misc_feature 1..30: note = chr7:98964581-98964611
  misc_feature 1..30: note = Hypo
  source 1..30: mol_type = genomic DNA

SEQ ID NO: 128065 - DNA, 30 bp, Homo sapiens; identical to SEQ ID NO: 98286
  misc_feature 1..30: note = chr7:98966380-98966410
  misc_feature 1..30: note = Hypo
  source 1..30: mol_type = genomic DNA

SEQ ID NO: 128066 - DNA, 95 bp, Homo sapiens; identical to SEQ ID NO: 98287
  misc_feature 1..95: note = chr7:98970776-98970871
  misc_feature 1..95: note = Hypo
  source 1..95: mol_type = genomic DNA

SEQ ID NO: 128067 - DNA, 80 bp, Homo sapiens; identical to SEQ ID NO: 98288
  misc_feature 1..80: note = chr7:98971520-98971600
  misc_feature 1..80: note = Hypo
  source 1..80: mol_type = genomic DNA

SEQ ID NO: 128068 - DNA, 316 bp, Homo sapiens; identical to SEQ ID NO: 98289
  misc_feature 1..316: note = chr7:98991466-98991782
  misc_feature 1..316: note = Hypo
  source 1..316: mol_type = genomic DNA

SEQ ID NO: 128069 - DNA, 403 bp, Homo sapiens; identical to SEQ ID NO: 98290
  misc_feature 1..403: note = chr7:99020763-99021166
  misc_feature 1..403: note = Hypo
  source 1..403: mol_type = genomic DNA

SEQ ID NO: 128070 - DNA, 31 bp, Homo sapiens; identical to SEQ ID NO: 98291
  misc_feature 1..31: note = chr7:99101324-99101355
  misc_feature 1..31: note = Hypo
  source 1..31: mol_type = genomic DNA

SEQ ID NO: 128071 - DNA, 185 bp, Homo sapiens; identical to SEQ ID NO: 98292
  misc_feature 1..185: note = chr7:99103865-99104050
  misc_feature 1..185: note = Hypo
  source 1..185: mol_type = genomic DNA

SEQ ID NO: 128072 - DNA, 35 bp, Homo sapiens; identical to SEQ ID NO: 98293
  misc_feature 1..35: note = chr7:99104258-99104293
  misc_feature 1..35: note = Hypo
  source 1..35: mol_type = genomic DNA

SEQ ID NO: 128073 - DNA, 247 bp, Homo sapiens; identical to SEQ ID NO: 98294
  misc_feature 1..247: note = chr7:99149175-99149422
  misc_feature 1..247: note = Hyper
  source 1..247: mol_type = genomic DNA

SEQ ID NO: 128074 - DNA, 849 bp, Homo sapiens
  misc_feature 1..849: note = chr7:99155751-99156600
  misc_feature 1..849: note = Hyper
  source 1..849: mol_type = genomic DNA
gacctactgagatttcgatcccacaacttagtgggtcccatctcacccaggccccgcaatcctcgccttctacttgtcagcgttgtactacactctgagcaggcacccctgtgctactcacggaagcgggaccattaggtcggccattcctcctcaccccacgacacgcacccactgggtcgggccgcctccttgcagggagtctcaaggatgggctggcgtcagggaggggcccagggggcgctttcccaacactggtcgcagtcattgttggtataacggctagagacgcccagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggcc

SEQ ID NO: 128075 - DNA, 167 bp, Homo sapiens; identical to SEQ ID NO: 98298
  misc_feature 1..167: note = chr7:99156815-99156982
  misc_feature 1..167: note = Hyper
  source 1..167: mol_type = genomic DNA

SEQ ID NO: 128076 - DNA, 617 bp, Homo sapiens
  misc_feature 1..617: note = chr7:99177666-99178283
  misc_feature 1..617: note = Hyper
  source 1..617: mol_type = genomic DNA
ggttcacatggggaccgtggcgatgacacggaagggacagccagttagagtctaggcccacttaggcgatgaagggcaggtgaagaaatcccgttccatcttcctgcagtcctcccttggggagtccacatcctatccttctctggaccggggcggctcctggagggaccgcgatcgaaatgaggcctccgagccgcccagagactccgaagtgcgcgcagcggaccacgcggtttccatgcgccccctagggtgggtgggctagctgtgcgccccagtgcggagaacggaggaggggtcggccccgtagcggctggaaacgcagttggcggcggggcccagcttgcggggcttctgatcgcaggggcggggcccgccgccggtttctaagggcctggcagagttcctgcagtcacggtcaggggtctttgctttcgtccatcccctcctggagaaagaacgcagcttctaacgccttctcggttgggcacccttcttgggaaagctccgcctaccattgcccttgtacctgccctctctctccctttcctgaagtgactgcccgtctctagcatcgtgttgtgaatgtgtcgagattttggcgctgcagcagcatc

SEQ ID NO: 128077 - DNA, 31 bp, Homo sapiens; identical to SEQ ID NO: 98302
  misc_feature 1..31: note = chr7:99591731-99591762
  misc_feature 1..31: note = Hypo
  source 1..31: mol_type = genomic DNA

SEQ ID NO: 128078 - DNA, 461 bp, Homo sapiens
  misc_feature 1..461: note = chr7:99595183-99595644
  misc_feature 1..461: note = Hyper
  source 1..461: mol_type = genomic DNA
cttttgactcattttgaggcccccgtcgtagggtacacgccctgggaatcgggggtcttccagtatagggaaccaccgagatgcgggccctccgaagtcctagagagggcgcctcggccgccggcacccgccacacttccggcctttgtgggccgcagcgacggcggtctgcggctgtcggttctgtttgttgctgtcactgctgtttgttcttgccagcggctaggtgtgtagttgcttggggctcctagcacgaggcctctgtccccaggcacgcagcgccagtctccggctgttgcgccctgggcgccgcctctctccggcccccctttgtttcctgagccagctgggaagactaaaagggtgggtcctgggagcggcccatggttcgacccttcttttcaggcatccttggagcatgcaggctgcagatttcaggccgaccccgctagcaccaaagt

SEQ ID NO: 128079 - DNA, 21 bp, Homo sapiens
  misc_feature 1..21: note = chr7:99648525-99648546
  misc_feature 1..21: note = Hypo
  source 1..21: mol_type = genomic DNA
atttgtgtggccgggcgcggt

SEQ ID NO: 128080 - DNA, 24 bp, Homo sapiens
  misc_feature 1..24: note = chr7:99649202-99649226
  misc_feature 1..24: note = Hypo
  source 1..24: mol_type = genomic DNA
ccacggcgccgggccccctaggga

SEQ ID NO: 128081 - DNA, 43 bp, Homo sapiens; identical to SEQ ID NO: 41387
  misc_feature 1..43: note = chr7:99691859-99691902
  misc_feature 1..43: note = Hypo
  source 1..43: mol_type = genomic DNA

SEQ ID NO: 128082 - DNA, 85 bp, Homo sapiens; identical to SEQ ID NO: 98308
  misc_feature 1..85: note = chr7:99700198-99700283
  misc_feature 1..85: note = Hypo
  source 1..85: mol_type = genomic DNA

SEQ ID NO: 128083 - DNA, 156 bp, Homo sapiens; identical to SEQ ID NO: 98309
  misc_feature 1..156: note = chr7:99723084-99723240
  misc_feature 1..156: note = Hypo
  source 1..156: mol_type = genomic DNA

SEQ ID NO: 128084 - DNA, 49 bp, Homo sapiens; identical to SEQ ID NO: 98310
  misc_feature 1..49: note = chr7:99725588-99725637
  misc_feature 1..49: note = Hyper
  source 1..49: mol_type = genomic DNA

SEQ ID NO: 128085 - DNA, 30 bp, Homo sapiens; identical to SEQ ID NO: 98311
  misc_feature 1..30: note = chr7:99736081-99736111
  misc_feature 1..30: note = Hypo
  source 1..30: mol_type = genomic DNA

SEQ ID NO: 128086 - DNA, 30 bp, Homo sapiens; identical to SEQ ID NO: 98312
  misc_feature 1..30: note = chr7:99745367-99745397
  misc_feature 1..30: note = Hypo
  source 1..30: mol_type = genomic DNA

SEQ ID NO: 128087 - DNA, 30 bp, Homo sapiens; identical to SEQ ID NO: 98313
  misc_feature 1..30: note = chr7:99751448-99751478
  misc_feature 1..30: note = Hypo
  source 1..30: mol_type = genomic DNA

SEQ ID NO: 128088 - DNA, 29 bp, Homo sapiens
  misc_feature 1..29: note = chr7:99775192-99775221
  misc_feature 1..29: note = Hyper
  source 1..29: mol_type = genomic DNA
tccggctcaaaaggcggggcctgggtgga

SEQ ID NO: 128089 - DNA, 41 bp, Homo sapiens; identical to SEQ ID NO: 41390
  misc_feature 1..41: note = chr7:99839918-99839959
  misc_feature 1..41: note = Hypo
  source 1..41: mol_type = genomic DNA

SEQ ID NO: 128090 - DNA, 25 bp, Homo sapiens
  misc_feature 1..25: note = chr7:99934958-99934983
  misc_feature 1..25: note = Hypo
  source 1..25: mol_type = genomic DNA
tgagccaccacgcccagctgccttg

SEQ ID NO: 128091 - DNA, 30 bp, Homo sapiens; identical to SEQ ID NO: 96039
  misc_feature 1..30: note = chr7:100035094-100035124
  misc_feature 1..30: note = Hypo
  source 1..30: mol_type = genomic DNA

SEQ ID NO: 128092 - DNA, 19 bp, Homo sapiens
  misc_feature 1..19: note = chr7:100047876-100047895
  misc_feature 1..19: note = Hypo
  source 1..19: mol_type = genomic DNA
ctcccgaaatgtcaggatt

SEQ ID NO: 128093 - DNA, 191 bp, Homo sapiens; identical to SEQ ID NO: 96041
  misc_feature 1..191: note = chr7:100088128-100088319
  misc_feature 1..191: note = Hypo
  source 1..191: mol_type = genomic DNA

SEQ ID NO: 128094 - DNA, 404 bp, Homo sapiens
  misc_feature 1..404: note = chr7:100091127-100091531
  misc_feature 1..404: note = Hyper
  source 1..404: mol_type = genomic DNA
ggagccagcagaggccgttggggggcaagcaaggacttgcttctgaggggagacgtgggtctcggcagtgcggacccgtccggtcatgctgaggtccccgaccttacccgcgttttcctttctcccccgcccgcggcacagccccaccccgcgctgccgctgcctctgcccctgccgccccagccggcccgcgagcgtgacgggaagctgctggaggtgatcgagcgcaagcgctgcgtgtgcaaggagatcaaggcgcgccaccgcccggaccgaggcctctgcaagcaggagagcatgcccatcctccccagctggcggcggggacccgagccccgcaagtccggcaccccgccctgccgccggcagcacacggtcctctgggacaccgccatctgaggcgg

SEQ ID NO: 128095 - DNA, 95 bp, Homo sapiens; identical to SEQ ID NO: 96043
  misc_feature 1..95: note = chr7:100104078-100104173
  misc_feature 1..95: note = Hypo
  source 1..95: mol_type = genomic DNA

SEQ ID NO: 128096 - DNA, 30 bp, Homo sapiens; identical to SEQ ID NO: 41394
  misc_feature 1..30: note = chr7:100118785-100118815
  misc_feature 1..30: note = Hypo
  source 1..30: mol_type = genomic DNA

SEQ ID NO: 128097 - DNA, 242 bp, Homo sapiens; identical to SEQ ID NO: 96045
  misc_feature 1..242: note = chr7:100167379-100167621
  misc_feature 1..242: note = Hyper
  source 1..242: mol_type = genomic DNA

SEQ ID NO: 128098 - DNA, 194 bp, Homo sapiens; identical to SEQ ID NO: 96046
  misc_feature 1..194: note = chr7:100167860-100168054
  misc_feature 1..194: note = Hyper
  source 1..194: mol_type = genomic DNA

SEQ ID NO: 128099 - DNA, 39 bp, Homo sapiens; identical to SEQ ID NO: 96047
  misc_feature 1..39: note = chr7:100170295-100170334
  misc_feature 1..39: note = Hypo
  source 1..39: mol_type = genomic DNA

SEQ ID NO: 128100 - DNA, 30 bp, Homo sapiens; identical to SEQ ID NO: 96048
  misc_feature 1..30: note = chr7:100173832-100173862
  misc_feature 1..30: note = Hypo
  source 1..30: mol_type = genomic DNA

SEQ ID NO: 128101 - DNA, 266 bp, Homo sapiens; identical to SEQ ID NO: 96049
  misc_feature 1..266: note = chr7:100179674-100179940
  misc_feature 1..266: note = Hypo
  source 1..266: mol_type = genomic DNA

SEQ ID NO: 128102 - DNA, 39 bp, Homo sapiens; identical to SEQ ID NO: 96050
  misc_feature 1..39: note = chr7:100207977-100208016
  misc_feature 1..39: note = Hypo
  source 1..39: mol_type = genomic DNA

SEQ ID NO: 128103 - DNA, 422 bp, Homo sapiens
  misc_feature 1..422: note = chr7:100253710-100254132
  misc_feature 1..422: note = Hyper
  source 1..422: mol_type = genomic DNA
agggcaccctcccgacgggaaaggaaggggcccggggccaggtggaggtgggttgcaaggtagggccctgtgcgcgcggggcgtctggggaggaccgagcgcaggggtggcgggagacccgagcctgagactcgacccgctcgtgcgcggaggtgacaggccccggggtgcccagagctcggatggatggcgcgggtttggaacgcagggctgcgggagccgggggcccgaggctcgctcacctccgccgtagacgcccccgctcatagtgcccgctgcgctgctagcggcccgtgggcggtggcgggatcagcaccgaggcggccggacagctcccgggatccctggcggggcgggactctcagcggccaattgggaggccggatcccccgctccaacggcgccgccgattggctgccagg

SEQ ID NO: 128104 - DNA, 91 bp, Homo sapiens; identical to SEQ ID NO: 96053
  misc_feature 1..91: note = chr7:100254614-100254705
  misc_feature 1..91: note = Hypo
  source 1..91: mol_type = genomic DNA

SEQ ID NO: 128105 - DNA, 23 bp, Homo sapiens
  misc_feature 1..23: note = chr7:100269563-100269586
  misc_feature 1..23: note = Hypo
  source 1..23: mol_type = genomic DNA
ccccatctcgttctttcttatgg

SEQ ID NO: 128106 - DNA, 119 bp, Homo sapiens; identical to SEQ ID NO: 96055
  misc_feature 1..119: note = chr7:100279900-100280019
  misc_feature 1..119: note = Hypo
  source 1..119: mol_type = genomic DNA

SEQ ID NO: 128107 - DNA, 120 bp, Homo sapiens; identical to SEQ ID NO: 96056
  misc_feature 1..120: note = chr7:100296125-100296245
  misc_feature 1..120: note = Hypo
  source 1..120: mol_type = genomic DNA

SEQ ID NO: 128108 - DNA, 644 bp, Homo sapiens
  misc_feature 1..644: note = chr7:100318091-100318735
  misc_feature 1..644: note = Hyper
  source 1..644: mol_type = genomic DNA
ctttcccagatagcacgctccgccagtcccaagggtgcgcaaccggctgcactcccctcccgcgacccagggcccgggagcagcccccatgacccacacgcacgtctgcagcagccccgctcacgccccggcgagcctcaacccaggcgtcctgcccctgctctgaccccgggtggcccctacccctggcgacccctcacgcacacagcctctcccccacccccacccgcgcacgcacacatgcagataacagccccgacccccggccagagccgcagagtccctgggccaccccggccgctcgctgcgctgcgccgcaccgcgctgtcctcccggagccggaccggggccaccgcgcccgctctgctccgacaccgcgccccctggacagccgccctctcctccaggcccgtggggctggccctgcaccgccgagcttcccgggatgagggcccccggtgtggtcacccggcgcgccccaggtcgctgagggaccccggccaggcgcggagatgggggtgcacggtgagtactcgcgggctgggcgctcccgcccgcccgggtccctgtttgagcggggatttagcgccccggctattggccaggaggtggctgggttcaaggaccggcgacttgtcaaggac

SEQ ID NO: 128109 - DNA, 39 bp, Homo sapiens; identical to SEQ ID NO: 41397
  misc_feature 1..39: note = chr7:100391505-100391544
  misc_feature 1..39: note = Hypo
  source 1..39: mol_type = genomic DNA

SEQ ID NO: 128110 - DNA, 51 bp, Homo sapiens; identical to SEQ ID NO: 96060
  misc_feature 1..51: note = chr7:100425811-100425862
  misc_feature 1..51: note = Hyper
  source 1..51: mol_type = genomic DNA

SEQ ID NO: 128111 - DNA, 112 bp, Homo sapiens; identical to SEQ ID NO: 96061
  misc_feature 1..112: note = chr7:100459369-100459481
  misc_feature 1..112: note = Hypo
  source 1..112: mol_type = genomic DNA

SEQ ID NO: 128112 - DNA, 30 bp, Homo sapiens; identical to SEQ ID NO: 96062
  misc_feature 1..30: note = chr7:100485916-100485946
  misc_feature 1..30: note = Hypo
  source 1..30: mol_type = genomic DNA

SEQ ID NO: 128113 - DNA, 456 bp, Homo sapiens; identical to SEQ ID NO: 96063
  misc_feature 1..456: note = chr7:100489889-100490345
  misc_feature 1..456: note = Hypo
  source 1..456: mol_type = genomic DNA

SEQ ID NO: 128114 - DNA, 353 bp, Homo sapiens; identical to SEQ ID NO: 96064
  misc_feature 1..353: note = chr7:100494408-100494761
  misc_feature 1..353: note = Hyper
  source 1..353: mol_type = genomic DNA

SEQ ID NO: 128115 - DNA, 37 bp, Homo sapiens; identical to SEQ ID NO: 96065
  misc_feature 1..37: note = chr7:100495406-100495443
  misc_feature 1..37: note = Hypo
  source 1..37: mol_type = genomic DNA

SEQ ID NO: 128116 - DNA, 19 bp, Homo sapiens
  misc_feature 1..19: note = chr7:100606618-100606637
  misc_feature 1..19: note = Hypo
  source 1..19: mol_type = genomic DNA
gccacggcacccggccggg

SEQ ID NO: 128117 - DNA, 72 bp, Homo sapiens; identical to SEQ ID NO: 96067
  misc_feature 1..72: note = chr7:100608819-100608891
  misc_feature 1..72: note = Hyper
  source 1..72: mol_type = genomic DNA

SEQ ID NO: 128118 - DNA, 59 bp, Homo sapiens; identical to SEQ ID NO: 96068
  misc_feature 1..59: note = chr7:100660623-100660682
  misc_feature 1..59: note = Hyper
  source 1..59: mol_type = genomic DNA

SEQ ID NO: 128119 - DNA, 77 bp, Homo sapiens; identical to SEQ ID NO: 96070
  misc_feature 1..77: note = chr7:100715916-100715993
  misc_feature 1..77: note = Hypo
  source 1..77: mol_type = genomic DNA

SEQ ID NO: 128120 - DNA, 17 bp, Homo sapiens
  misc_feature 1..17: note = chr7:100723832-100723849
  misc_feature 1..17: note = Hypo
  source 1..17: mol_type = genomic DNA
gtttgttttttgagacg

SEQ ID NO: 128121 - DNA, 124 bp, Homo sapiens; identical to SEQ ID NO: 96072
  misc_feature 1..124: note = chr7:100770176-100770300
  misc_feature 1..124: note = Hyper
  source 1..124: mol_type = genomic DNA

SEQ ID NO: 128122 - DNA, 145 bp, Homo sapiens; identical to SEQ ID NO: 41401
  misc_feature 1..145: note = chr7:100799106-100799251
  misc_feature 1..145: note = Hypo
  source 1..145: mol_type = genomic DNA

SEQ ID NO: 128123 - DNA, 30 bp, Homo sapiens; identical to SEQ ID NO: 96074
  misc_feature 1..30: note = chr7:100806035-100806065
  misc_feature 1..30: note = Hyper
  source 1..30: mol_type = genomic DNA

SEQ ID NO: 128124 - DNA, 665 bp, Homo sapiens; identical to SEQ ID NO: 96075
  misc_feature 1..665: note = chr7:100807394-100808059
  misc_feature 1..665: note = Hyper
  source 1..665: mol_type = genomic DNA

SEQ ID NO: 128125 - DNA, 113 bp, Homo sapiens; identical to SEQ ID NO: 96076
  misc_feature 1..113: note = chr7:100808389-100808502
  misc_feature 1..113: note = Hyper
  source 1..113: mol_type = genomic DNA

SEQ ID NO: 128126 - DNA, 218 bp, Homo sapiens; identical to SEQ ID NO: 96077
  misc_feature 1..218: note = chr7:100809337-100809555
  misc_feature 1..218: note = Hyper
  source 1..218: mol_type = genomic DNA

SEQ ID NO: 128127 - DNA, 30 bp, Homo sapiens; identical to SEQ ID NO: 96078
  misc_feature 1..30: note = chr7:100809815-100809845
  misc_feature 1..30: note = Hyper
  source 1..30: mol_type = genomic DNA

SEQ ID NO: 128128 - DNA, 48 bp, Homo sapiens; identical to SEQ ID NO: 96079
  misc_feature 1..48: note = chr7:100813879-100813927
  misc_feature 1..48: note = Hyper
  source 1..48: mol_type = genomic DNA

SEQ ID NO: 128129 - DNA, 30 bp, Homo sapiens; identical to SEQ ID NO: 96080
  misc_feature 1..30: note = chr7:100814949-100814979
  misc_feature 1..30: note = Hyper
  source 1..30: mol_type = genomic DNA

SEQ ID NO: 128130 - DNA, 278 bp, Homo sapiens; identical to SEQ ID NO: 96081
  misc_feature 1..278: note = chr7:100815652-100815930
  misc_feature 1..278: note = Hyper
  source 1..278: mol_type = genomic DNA

SEQ ID NO: 128131 - DNA, 44 bp, Homo sapiens; identical to SEQ ID NO: 96082
  misc_feature 1..44: note = chr7:100816611-100816655
  misc_feature 1..44: note = Hyper
  source 1..44: mol_type = genomic DNA

SEQ ID NO: 128132 - DNA, 87 bp, Homo sapiens; identical to SEQ ID NO: 96083
  misc_feature 1..87: note = chr7:100817650-100817737
  misc_feature 1..87: note = Hyper
  source 1..87: mol_type = genomic DNA

SEQ ID NO: 128133 - DNA, 69 bp, Homo sapiens; identical to SEQ ID NO: 96084
  misc_feature 1..69: note = chr7:100822573-100822642
  misc_feature 1..69: note = Hyper
  source 1..69: mol_type = genomic DNA

SEQ ID NO: 128134 - DNA, 720 bp, Homo sapiens
  misc_feature 1..720: note = chr7:100823050-100823770
  misc_feature 1..720: note = Hyper
  source 1..720: mol_type = genomic DNA
gagcgatctgcttggcgggggttcccctgggcgccggaccctggggacaggtgggagcgacatggcaacagaggggggcgggggagcgcttctggacacctgaagcgcagcctctgactcagttttctgggtcttcggactgggaggggctgggcagaagggggcgcagccgcttggtccccctgaggggcggtggccttctgctgccccattctgcggtggaggagcacgctagccccctccccagtccccaggcccggccgcccccctacctcgccggagccggagctggagccagggccgagatgccgcaaagccaagcggggcgggcggcgggcgcagacacccccggtgccaagagagaggtccctttggagcccccaagagtcaaaggaggatgacgcgcggggactcggccgcgctgtcggagcccgactctaacgtcggtcagcgctggggcagcgccgcagctccgttggcgacgcgggccggggcgcccatcggttcaggggttcgggtggcacgcgtggctcccccggcgacgctccggcggcagcttcgaggggcggagaccccggcgacgcggaagaaacccgggacggatccggagcggactcgtgccctgctggcggggccgggggtcggggtgcgccctgggcagctgggtggcctcaagccctactggcgagactccgccctgtgtcccggctggggagtggg

SEQ ID NO: 128135 - DNA, 273 bp, Homo sapiens
  misc_feature 1..273: note = chr7:100845293-100845566
  misc_feature 1..273: note = Hyper
  source 1..273: mol_type = genomic DNA
ctccttggggataggcgggaacagagttcagggctggcgcggtggccaaaggccagtctgggtggccccaacccgggacggggagggagcgggccctgggccaggatcgcggggcggaggccggggctcacctacggtgcggatgggcgcgcggaagggcagcgggaggccccggcggcccaggaacagctgcagggccacgcttagcagcggacgcagagcctcctgcgtcctctgcacccacgagctctgcgggttcgggaactgctggaa

SEQ ID NO: 128136 - DNA, 30 bp, Homo sapiens; identical to SEQ ID NO: 41402
  misc_feature 1..30: note = chr7:100858230-100858260
  misc_feature 1..30: note = Hypo
  source 1..30: mol_type = genomic DNA

SEQ ID NO: 128137 - DNA, 39 bp, Homo sapiens; identical to SEQ ID NO: 41403
  misc_feature 1..39: note = chr7:100894771-100894810
  misc_feature 1..39: note = Hypo
  source 1..39: mol_type = genomic DNA

SEQ ID NO: 128138 - DNA, 34 bp, Homo sapiens; identical to SEQ ID NO: 41404
  misc_feature 1..34: note = chr7:100897086-100897120
  misc_feature 1..34: note = Hypo
  source 1..34: mol_type = genomic DNA

SEQ ID NO: 128139 - DNA, 161 bp, Homo sapiens; identical to SEQ ID NO: 96092
  misc_feature 1..161: note = chr7:100912996-100913157
  misc_feature 1..161: note = Hypo
  source 1..161: mol_type = genomic DNA

SEQ ID NO: 128140 - DNA, 358 bp, Homo sapiens; identical to SEQ ID NO: 96093
  misc_feature 1..358: note = chr7:100943169-100943527
  misc_feature 1..358: note = Hyper
  source 1..358: mol_type = genomic DNA

SEQ ID NO: 128141 - DNA, 130 bp, Homo sapiens
  misc_feature 1..130: note = chr7:100946544-100946674
  misc_feature 1..130: note = Hyper
  source 1..130: mol_type = genomic DNA
gactaataaccccaccgccaccgcgggactcagacgcgaaccaaccgcttgcctgctctaccccgcctgagctttcctggggaccagcccttccctgtccgtcctagccagcgaccgaaccccggggccc

SEQ ID NO: 128142 - DNA, 160 bp, Homo sapiens; identical to SEQ ID NO: 96095
  misc_feature 1..160: note = chr7:100951829-100951989
  misc_feature 1..160: note = Hyper
  source 1..160: mol_type = genomic DNA

SEQ ID NO: 128143 - DNA, 30 bp, Homo sapiens; identical to SEQ ID NO: 41405
  misc_feature 1..30: note = chr7:100967105-100967135
  misc_feature 1..30: note = Hypo
  source 1..30: mol_type = genomic DNA

SEQ ID NO: 128144 - DNA, 647 bp, Homo sapiens; identical to SEQ ID NO: 96097
  misc_feature 1..647: note = chr7:101005996-101006643
  misc_feature 1..647: note = Hyper
  source 1..647: mol_type = genomic DNA

SEQ ID NO: 128145 - DNA, 18 bp, Homo sapiens
  misc_feature 1..18: note = chr7:101056505-101056523
  misc_feature 1..18: note = Hypo
  source 1..18: mol_type = genomic DNA
aaagagacttgtggccgg

SEQ ID NO: 128146 - DNA, 24 bp, Homo sapiens
  misc_feature 1..24: note = chr7:101090772-101090796
  misc_feature 1..24: note = Hypo
  source 1..24: mol_type = genomic DNA
aacttcctccgttatgatttttgc

SEQ ID NO: 128147 - DNA, 41 bp, Homo sapiens; identical to SEQ ID NO: 96100
  misc_feature 1..41: note = chr7:101116625-101116666
  misc_feature 1..41: note = Hypo
  source 1..41: mol_type = genomic DNA

SEQ ID NO: 128148 - DNA, 87 bp, Homo sapiens; identical to SEQ ID NO: 41407
  misc_feature 1..87: note = chr7:101131936-101132023
  misc_feature 1..87: note = Hypo
  source 1..87: mol_type = genomic DNA

SEQ ID NO: 128149 - DNA, 38 bp, Homo sapiens; identical to SEQ ID NO: 96102
  misc_feature 1..38: note = chr7:101137675-101137713
  misc_feature 1..38: note = Hypo
  source 1..38: mol_type = genomic DNA

SEQ ID NO: 128150 - DNA, 30 bp, Homo sapiens; identical to SEQ ID NO: 96103
  misc_feature 1..30: note = chr7:101151473-101151503
  misc_feature 1..30: note = Hypo
  source 1..30: mol_type = genomic DNA

SEQ ID NO: 128151 - DNA, 30 bp, Homo sapiens; identical to SEQ ID NO: 96104
  misc_feature 1..30: note = chr7:101178233-101178263
  misc_feature 1..30: note = Hypo
  source 1..30: mol_type = genomic DNA

SEQ ID NO: 128152 - DNA, 230 bp, Homo sapiens; identical to SEQ ID NO: 96105
  misc_feature 1..230: note = chr7:101191125-101191355
  misc_feature 1..230: note = Hypo
  source 1..230: mol_type = genomic DNA

SEQ ID NO: 128153 - DNA, 30 bp, Homo sapiens; identical to SEQ ID NO: 96106
  misc_feature 1..30: note = chr7:101206277-101206307
  misc_feature 1..30: note = Hypo
  source 1..30: mol_type = genomic DNA

SEQ ID NO: 128154 - DNA, 30 bp, Homo sapiens; identical to SEQ ID NO: 96107
  misc_feature 1..30: note = chr7:101207916-101207946
  misc_feature 1..30: note = Hypo
  source 1..30: mol_type = genomic DNA

SEQ ID NO: 128155 - DNA, 333 bp, Homo sapiens; identical to SEQ ID NO: 96108
  misc_feature 1..333: note = chr7:101241831-101242164
  misc_feature 1..333: note = Hypo
  source 1..333: mol_type = genomic DNA

SEQ ID NO: 128156 - DNA, 30 bp, Homo sapiens; identical to SEQ ID NO: 96109
  misc_feature 1..30: note = chr7:101262039-101262069
  misc_feature 1..30: note = Hypo
  source 1..30: mol_type = genomic DNA

SEQ ID NO: 128157 - DNA, 30 bp, Homo sapiens; identical to SEQ ID NO: 96110
  misc_feature 1..30: note = chr7:101392564-101392594
  misc_feature 1..30: note = Hypo
  source 1..30: mol_type = genomic DNA

SEQ ID NO: 128158 - DNA, 68 bp, Homo sapiens; identical to SEQ ID NO: 96111
  misc_feature 1..68: note = chr7:101475790-101475858
  misc_feature 1..68: note = Hypo
  source 1..68: mol_type = genomic DNA

SEQ ID NO: 128159 - DNA, 30 bp, Homo sapiens; identical to SEQ ID NO: 96112
  misc_feature 1..30: note = chr7:101480043-101480073
  misc_feature 1..30: note = Hypo
  source 1..30: mol_type = genomic DNA

SEQ ID NO: 128160 - DNA, 38 bp, Homo sapiens; identical to SEQ ID NO: 96113
  misc_feature 1..38: note = chr7:101521914-101521952
  misc_feature 1..38: note = Hypo
  source 1..38: mol_type = genomic DNA

SEQ ID NO: 128161 - DNA, 149 bp, Homo sapiens; identical to SEQ ID NO: 96114
  misc_feature 1..149: note = chr7:101586167-101586316
  misc_feature 1..149: note = Hypo
  source 1..149: mol_type = genomic DNA

SEQ ID NO: 128162 - DNA, 30 bp, Homo sapiens; identical to SEQ ID NO: 96115
  misc_feature 1..30: note = chr7:101596278-101596308
  misc_feature 1..30: note = Hypo
  source 1..30: mol_type = genomic DNA

SEQ ID NO: 128163 - DNA, 39 bp, Homo sapiens; identical to SEQ ID NO: 96116
  misc_feature 1..39: note = chr7:101603269-101603308
  misc_feature 1..39: note = Hypo
  source 1..39: mol_type = genomic DNA

SEQ ID NO: 128164 - DNA, 89 bp, Homo sapiens; identical to SEQ ID NO: 96117
  misc_feature 1..89: note = chr7:101627757-101627846
  misc_feature 1..89: note = Hypo
  source 1..89: mol_type = genomic DNA

SEQ ID NO: 128165 - DNA, 30 bp, Homo sapiens; identical to SEQ ID NO: 96118
  misc_feature 1..30: note = chr7:101628185-101628215
  misc_feature 1..30: note = Hypo
  source 1..30: mol_type = genomic DNA

SEQ ID NO: 128166 - DNA, 120 bp, Homo sapiens; identical to SEQ ID NO: 96119
  misc_feature 1..120: note = chr7:101630456-101630576
  misc_feature 1..120: note = Hypo
  source 1..120: mol_type = genomic DNA

SEQ ID NO: 128167 - DNA, 115 bp, Homo sapiens; identical to SEQ ID NO: 41412
  misc_feature 1..115: note = chr7:101652590-101652705
  misc_feature 1..115: note = Hypo
  source 1..115: mol_type = genomic DNA

SEQ ID NO: 128168 - DNA, 78 bp, Homo sapiens; identical to SEQ ID NO: 15018
  misc_feature 1..78: note = chr7:101656381-101656459
  misc_feature 1..78: note = Hypo
  source 1..78: mol_type = genomic DNA

SEQ ID NO: 128169 - DNA, 30 bp, Homo sapiens; identical to SEQ ID NO: 41414
  misc_feature 1..30: note = chr7:101707051-101707081
  misc_feature 1..30: note = Hypo
  source 1..30: mol_type = genomic DNA

SEQ ID NO: 128170 - DNA, 102 bp, Homo sapiens; identical to SEQ ID NO: 96123
  misc_feature 1..102: note = chr7:101707433-101707535
  misc_feature 1..102: note = Hypo
  source 1..102: mol_type = genomic DNA

SEQ ID NO: 128171 - DNA, 101 bp, Homo sapiens; identical to SEQ ID NO: 96124
  misc_feature 1..101: note = chr7:101707595-101707696
  misc_feature 1..101: note = Hypo
  source 1..101: mol_type = genomic DNA

SEQ ID NO: 128172 - DNA, 30 bp, Homo sapiens; identical to SEQ ID NO: 96126
  misc_feature 1..30: note = chr7:102091922-102091952
  misc_feature 1..30: note = Hypo
  source 1..30: mol_type = genomic DNA

SEQ ID NO: 128173 - DNA, 97 bp, Homo sapiens; identical to SEQ ID NO: 41417
  misc_feature 1..97: note = chr7:102097002-102097099
  misc_feature 1..97: note = Hypo
  source 1..97: mol_type = genomic DNA

SEQ ID NO: 128174 - DNA, 29 bp, Homo sapiens
  misc_feature 1..29: note = chr7:102133076-102133105
  misc_feature 1..29: note = Hypo
  source 1..29: mol_type = genomic DNA
acaacctggtaaggtcggatcaacttcct

SEQ ID NO: 128175 - DNA, 29 bp, Homo sapiens
  misc_feature 1..29: note = chr7:102232246-102232275
  misc_feature 1..29: note = Hypo
  source 1..29: mol_type = genomic DNA
acaacctggtaaggtcggatcaacttcct

SEQ ID NO: 128176 - DNA, 41 bp, Homo sapiens; identical to SEQ ID NO: 96134
  misc_feature 1..41: note = chr7:102782018-102782059
  misc_feature 1..41: note = Hypo
  source 1..41: mol_type = genomic DNA

SEQ ID NO: 128177 - DNA, 40 bp, Homo sapiens; identical to SEQ ID NO: 96135
  misc_feature 1..40: note = chr7:102782119-102782159
  misc_feature 1..40: note = Hypo
  source 1..40: mol_type = genomic DNA

SEQ ID NO: 128178 - DNA, 145 bp, Homo sapiens; identical to SEQ ID NO: 96136
  misc_feature 1..145: note = chr7:102921382-102921527
  misc_feature 1..145: note = Hyper
  source 1..145: mol_type = genomic DNA

SEQ ID NO: 128179 - DNA, 903 bp, Homo sapiens; identical to SEQ ID NO: 96138
  misc_feature 1..903: note = chr7:103085831-103086734
  misc_feature 1..903: note = Hyper
  source 1..903: mol_type = genomic DNA

SEQ ID NO: 128180 - DNA, 86 bp, Homo sapiens; identical to SEQ ID NO: 96140
  misc_feature 1..86: note = chr7:103395555-103395641
  misc_feature 1..86: note = Hypo
  source 1..86: mol_type = genomic DNA

SEQ ID NO: 128181 - DNA, 1959 bp, Homo sapiens
  misc_feature 1..1959: note = chr7:103629059-103631018
  misc_feature 1..1959: note = Hyper
  source 1..1959: mol_type = genomic DNA
ctggctggtgagcagcgggaactttgcggtcgagcggcgcggggcagccacagacctgggcgcttcaatctgtcaccagcctgcccgcaaagcccagcgacagcccccaacgcccccccggggacccatctggggggaccgggagcaggacaaaggtctgaaatccaagtcctaggagtaaagaaacaaaatgcgcaggttcaatttaaagtgcctgcggtaagtacggggagtgagggggaaagacaccggcctccaagaattctcaggcgtttagcacaagcaccagctcattaccaggagatgcgttcggggagtggggacatggagaatgaatcccaacttgtgactccattctccactaactttattctcgctccctggaccaagcgcatcgctggggccagggttgtcatggttcttgtttccaaggccccttggaagaaggaaagggatgagaaaggtgcgctggcgggcgcacccggcggcggcgagcgcggaggtgctgcggtacctaccatggtattcttgtcccggaacgtagtaggtggggttgcccgcaatatgcagggaaatgagcacctcgccctgctccccatccccttccagctccccgtggtgggtgcacaggaaaaagaagggcgaaaagcgggggtaatagccagccgccgcgcgcgccctcagcgtcgcccccagcaacagcgctaggaggaaagtctgccgggcccagccactgcgctccatgccgccgccgccgccgccgccgccgcgcgccctacgcgccgctcgctcattcagttttggagacgccgggacggaggagccacgcggagagaaggcgagaagaaggcggacgggagcggaacgggctcgggagcgggcctgggagcgggcccccgccgagaagttccgcgggagacggcggctcccaaagttactttgggccgcgggagcgcgggaccggggctgcgggcgccgagagcgcgtcgtctgccgcctccgtgcgccgccgccgcctctgcgcgacgcccctcggccaggcctgggaaagcgcccgccccgctccacaccttcttaaagccccgggcgccgcgtcccccccgccgccgccacacgtgtcccggccgctcccccgcccccgcgcgccgccccgcccgccccccgccctctcgggctggctcggcggcacctcgcgcggcgaggggcgcacgcgtccccggagtccccggccagcgcccggttcgcacccgggaggacagggaggggcgcccgccggggagcgggacggggacgctgtcgaggaccgctgagcccgcgactcttctgcgagggacgtcaaagccccgcagagggcacctcccgtccagctgtctgaaggggaaggccagcccctttggccgtcagtgtgccctgtttttcctgggaggatgcgtgagggaaggagaggggcggcagggacggccgctggcgccggtttctttgtctgagccggctgcgtcccgcgcccctcggggctcgcagtctgccagtccgggcggcccgcactcgttctgggaatccgcccgaggccgcgaaccgctaggggccctcgcgctcccttcccacccaggccccctgtccctcccgccgcggccgcccggcccctcgcggcagcgacagagcctcatctgtagaggattttaaaatgagattaagcgaaagtggaattggcagactcgagtggtgcctggaaatggtgatttgtgctgctcggttgtggggaattgtaaggcaggaagggctggcggagctaagatccgacaggctctcttcgccggactgttctgttattcattgcttctgggctcttcaggcagagatgggtgttgtaattttttaaatcagtgtttatttcctttaaatgtcggttatgaccaatggccctgaaatcgggggagggaaaaacgttcaggggagatg

SEQ ID NO: 128182 - DNA, 1545 bp, Homo sapiens
  misc_feature 1..1545: note = chr7:103968582-103970127
  misc_feature 1..1545: note = Hyper
  source 1..1545: mol_type = genomic DNA
caaagatgcagaggtcgaagcacgtttctgtgcggtgatgaaatgctcgctgaatcagcctctcgagcccggcctctcacacccaccaggatcctggggttgtctctaggatccctgtgggtgctcctgccaccttcttagactaccctcgccctcctaatccaggcccacttctctggctcatgtccaccccttgatgggcgttccggggtcgtcactgtcctctgcgcccctgggcactggcagcgcgggccgggcagcggggagggaggcgggaagcagagcgggaggcgccccgggcttgcgcgccgcggtgctccacgagggatttgccgccttcagctgcagcagctgcagcggcggcggcgggaagaggggtggagggtggtgaggagggccggagcccgggccaggagggagggaggggagccgggaggctgtgccaggcgagccggaggggtgctccgcgctcccccgccctccttccgggagcgaggatgcagactctgaaactggtgctgctgggctgaggcggaggcaggggagttgcagcgcgcgaggctccgtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccggtgagtgcgcgctcacctccgcggaggcggaggaccccggggcgcccgagccggggaggggccagagtgggagggacgggggctgtgcgcgccgctgcgagccaagccgcctaatccgctcaggcgtcgaggtgtggggggcgggagcccagcgaggccggaacccccggggttccccagccccggcgctggcgcctcgtcccggggctttcgtgagcctcccaagtgtgggggacgcccactcagagggacgccccggaggcagggcggttgtggggccgagtccgctcagaactaaggatggtgggtggagaagtggccgcttagagagatggggccggggttccgtgctgagggactaaggagggactgacagggcgaagtgaaaagcggatttggagaggtcatagtggaaggagcagccagcctgccctgcccctcgctgctgggactat

SEQ ID NO: 128183 - DNA, 42 bp, Homo sapiens; identical to SEQ ID NO: 96151
  misc_feature 1..42: note = chr7:104628051-104628093
  misc_feature 1..42: note = Hypo
  source 1..42: mol_type = genomic DNA

SEQ ID NO: 128184 - DNA, 30 bp, Homo sapiens; identical to SEQ ID NO: 96152
  misc_feature 1..30: note = chr7:105086390-105086420
  misc_feature 1..30: note = Hypo
  source 1..30: mol_type = genomic DNA

SEQ ID NO: 128185 - DNA, 79 bp, Homo sapiens; identical to SEQ ID NO: 96153
  misc_feature 1..79: note = chr7:105171453-105171532
  misc_feature 1..79: note = Hypo
  source 1..79: mol_type = genomic DNA

SEQ ID NO: 128186 - DNA, 30 bp, Homo sapiens; identical to SEQ ID NO: 96154
  misc_feature 1..30: note = chr7:105220974-105221004
  misc_feature 1..30: note = Hypo
  source 1..30: mol_type = genomic DNA

SEQ ID NO: 128187 - DNA, 296 bp, Homo sapiens; identical to SEQ ID NO: 96155
  misc_feature 1..296: note = chr7:105279375-105279671
  misc_feature 1..296: note = Hypo
  source 1..296: mol_type = genomic DNA

SEQ ID NO: 128188 - DNA, 30 bp, Homo sapiens; identical to SEQ ID NO: 41420
  misc_feature 1..30: note = chr7:105280417-105280447
  misc_feature 1..30: note = Hypo
  source 1..30: mol_type = genomic DNA

SEQ ID NO: 128189 - DNA, 66 bp, Homo sapiens; identical to SEQ ID NO: 96157
  misc_feature 1..66: note = chr7:105288157-105288223
  misc_feature 1..66: note = Hypo
  source 1..66: mol_type = genomic DNA

SEQ ID NO: 128190 - DNA, 30 bp, Homo sapiens; identical to SEQ ID NO: 96158
  misc_feature 1..30: note = chr7:105331896-105331926
  misc_feature 1..30: note = Hyper
  source 1..30: mol_type = genomic DNA

SEQ ID NO: 128191 - DNA, 30 bp, Homo sapiens; identical to SEQ ID NO: 96159
  misc_feature 1..30: note = chr7:105432522-105432552
  misc_feature 1..30: note = Hypo
  source 1..30: mol_type = genomic DNA

SEQ ID NO: 128192 - DNA, 115 bp, Homo sapiens; identical to SEQ ID NO: 96161
  misc_feature 1..115: note = chr7:105649670-105649785
  misc_feature 1..115: note = Hypo
  source 1..115: mol_type = genomic DNA

SEQ ID NO: 128193 - DNA, 30 bp, Homo sapiens; identical to SEQ ID NO: 96162
  misc_feature 1..30: note = chr7:105753818-105753848
  misc_feature 1..30: note = Hypo
  source 1..30: mol_type = genomic DNA

SEQ ID NO: 128194 - DNA, 35 bp, Homo sapiens; identical to SEQ ID NO: 96163
  misc_feature 1..35: note = chr7:106123211-106123246
  misc_feature 1..35: note = Hypo
  source 1..35: mol_type = genomic DNA

SEQ ID NO: 128195 - DNA, 95 bp, Homo sapiens; identical to SEQ ID NO: 96164
  misc_feature 1..95: note = chr7:106123306-106123401
  misc_feature 1..95: note = Hypo
  source 1..95: mol_type = genomic DNA

SEQ ID NO: 128196 - DNA, 126 bp, Homo sapiens; identical to SEQ ID NO: 96165
  misc_feature 1..126: note = chr7:106507970-106508096
  misc_feature 1..126: note = Hypo
  source 1..126: mol_type = genomic DNA

SEQ ID NO: 128197 - DNA, 290 bp, Homo sapiens; identical to SEQ ID NO: 41424
  misc_feature 1..290: note = chr7:106508656-106508946
  misc_feature 1..290: note = Hypo
  source 1..290: mol_type = genomic DNA

SEQ ID NO: 128198 - DNA, 39 bp, Homo sapiens; identical to SEQ ID NO: 96168
  misc_feature 1..39: note = chr7:106609350-106609389
  misc_feature 1..39: note = Hypo
  source 1..39: mol_type = genomic DNA

SEQ ID NO: 128199 - DNA, 22 bp, Homo sapiens
  misc_feature 1..22: note = chr7:106636238-106636260
  misc_feature 1..22: note = Hypo
  source 1..22: mol_type = genomic DNA
aaaaacccgtgtattttacttt

SEQ ID NO: 128200 - DNA, 30 bp, Homo sapiens; identical to SEQ ID NO: 96170
  misc_feature 1..30: note = chr7:106637063-106637093
  misc_feature 1..30: note = Hypo
  source 1..30: mol_type = genomic DNA

SEQ ID NO: 128201 - DNA, 30 bp, Homo sapiens; identical to SEQ ID NO: 96171
  misc_feature 1..30: note = chr7:106644946-106644976
  misc_feature 1..30: note = Hypo
  source 1..30: mol_type = genomic DNA

SEQ ID NO: 128202 - DNA, 79 bp, Homo sapiens; identical to SEQ ID NO: 96172
  misc_feature 1..79: note = chr7:106651422-106651501
  misc_feature 1..79: note = Hypo
  source 1..79: mol_type = genomic DNA

SEQ ID NO: 128203 - DNA, 18 bp, Homo sapiens
  misc_feature 1..18: note = chr7:106653764-106653782
  misc_feature 1..18: note = Hypo
  source 1..18: mol_type = genomic DNA
aaaggctggtcatggcgg

SEQ ID NO: 128204 - DNA, 88 bp, Homo sapiens; identical to SEQ ID NO: 96174
  misc_feature 1..88: note = chr7:106684832-106684920
  misc_feature 1..88: note = Hyper
  source 1..88: mol_type = genomic DNA

SEQ ID NO: 128205 - DNA, 749 bp, Homo sapiens; identical to SEQ ID NO: 96175
  misc_feature 1..749: note = chr7:106685171-106685920
  misc_feature 1..749: note = Hyper
  source 1..749: mol_type = genomic DNA

SEQ ID NO: 128206 - DNA, 103 bp, Homo sapiens; identical to SEQ ID NO: 96176
  misc_feature 1..103: note = chr7:106712145-106712248
  misc_feature 1..103: note = Hypo
  source 1..103: mol_type = genomic DNA

SEQ ID NO: 128207 - DNA, 16 bp, Homo sapiens
  misc_feature 1..16: note = chr7:106748394-106748410
  misc_feature 1..16: note = Hypo
  source 1..16: mol_type = genomic DNA
ccggccaagagatgtt

SEQ ID NO: 128208 - DNA, 20 bp, Homo sapiens
  misc_feature 1..20: note = chr7:106796956-106796976
  misc_feature 1..20: note = Hypo
  source 1..20: mol_type = genomic DNA
ctcttcatttagggccgggc

SEQ ID NO: 128209 - DNA, 20 bp, Homo sapiens
  misc_feature 1..20: note = chr7:106797276-106797296
  misc_feature 1..20: note = Hypo
  source 1..20: mol_type = genomic DNA
gaaaccgagacagcttgttc

SEQ ID NO: 128210 - DNA, 105 bp, Homo sapiens; identical to SEQ ID NO: 96180
  misc_feature 1..105: note = chr7:106797653-106797758
  misc_feature 1..105: note = Hypo
  source 1..105: mol_type = genomic DNA

SEQ ID NO: 128211 - DNA, 90 bp, Homo sapiens; identical to SEQ ID NO: 96181
  misc_feature 1..90: note = chr7:106802877-106802967
  misc_feature 1..90: note = Hypo
  source 1..90: mol_type = genomic DNA

SEQ ID NO: 128212 - DNA, 178 bp, Homo sapiens; identical to SEQ ID NO: 96182
  misc_feature 1..178: note = chr7:106837489-106837667
  misc_feature 1..178: note = Hypo
  source 1..178: mol_type = genomic DNA

SEQ ID NO: 128213 - DNA, 30 bp, Homo sapiens; identical to SEQ ID NO: 96183
  misc_feature 1..30: note = chr7:107060805-107060835
  misc_feature 1..30: note = Hypo
  source 1..30: mol_type = genomic DNA

SEQ ID NO: 128214 - DNA, 100 bp, Homo sapiens; identical to SEQ ID NO: 96184
  misc_feature 1..100: note = chr7:107148303-107148403
  misc_feature 1..100: note = Hypo
  source 1..100: mol_type = genomic DNA

SEQ ID NO: 128215 - DNA, 1363 bp, Homo sapiens; identical to SEQ ID NO: 96186
  misc_feature 1..1363: note = chr7:107300982-107302345
  misc_feature 1..1363: note = Hyper
  source 1..1363: mol_type = genomic DNA

SEQ ID NO: 128216 - DNA, 224 bp, Homo sapiens; identical to SEQ ID NO: 96188
  misc_feature 1..224: note = chr7:107483694-107483918
  misc_feature 1..224: note = Hypo
  source 1..224: mol_type = genomic DNA

SEQ ID NO: 128217 - DNA, 89 bp, Homo sapiens; identical to SEQ ID NO: 96189
  misc_feature 1..89: note = chr7:107642639-107642728
  misc_feature 1..89: note = Hyper
  source 1..89: mol_type = genomic DNA

SEQ ID NO: 128218 - DNA, 113 bp, Homo sapiens; identical to SEQ ID NO: 96190
  misc_feature 1..113: note = chr7:107643070-107643183
  misc_feature 1..113: note = Hyper
  source 1..113: mol_type = genomic DNA

SEQ ID NO: 128219 - DNA, 273 bp, Homo sapiens; identical to SEQ ID NO: 96191
  misc_feature 1..273: note = chr7:107643722-107643995
  misc_feature 1..273: note = Hyper
  source 1..273: mol_type = genomic DNA

SEQ ID NO: 128220 - DNA, 2439 bp, Homo sapiens
  misc_feature 1..2439: note = chr7:108095272-108097711
  misc_feature 1..2439: note = Hyper
  source 1..2439: mol_type = genomic DNA
acccgcacttctgagcgttaaccatctgggactcggaaaggaaaagaaagctttcttctcaggacagttctgcgccggtggtagccaagggctggagcccctgatgcgaagaaaagggaaggagagaggcggggtgcgaaagaaacgccaccgctcggcgccctccctcggtgcccgcggcgcaggggccacccgccagcgtacgggggacgaagatgtggccgcgggcgcgggcgggaggggaggcgatccggggaaggaagcggcctgttcgccagccccggggcccggggagccctccagcagcgcttgcggccctgaggacaccgctttgggagaaatgacgactcccttgctcaccctactgcgacaccccgtccccctccgcactctagcagatgcgggccgggagtagctgagctggccaaccgcctgggaccaggatgcggcagcgcccacccgcgcggcgtggagggggccgggggcggcgctcggcgcagatggcgctcgctgcgagatggatgctccagggcgggtaatcactcctggctcaacacagcatcccgggcggagcggatgccagatcccaccgctaagagcctgggctgggaaagcaatctttccaggcagcccccagcccggtgcgccggccccgacaagtcccagccctcggaggcagggcggggcgcagggactcccgggacccgcacctgtaaggccgacaaagcccccgcaagcgccccacccctctgtcctccgtgtctctctcgttccgcctcgattccccgagccctctccaggcagcgactggagaagcgaagtcggcctcgcccccgaactccgtggtcagcacaggtgtacgcacttccgaacaaagcccacgcccagacgtgtccgcaggggcccgaacaggcacacgcccgtgcgctcccggcccggcccccgcgctcctcgccccgccggcactgtggcgtgacgccccgcgcctccgtgtccaagcccgggaagccgccgtgccgggcccgcaggctctccatgcccaactgcccacgagcaagagctctgggcagggcttcccggaaagcgtggggtgcgggcgcggagcagaagttggccacaggctggagggggtggtgggtgccggcgctgctggatttcagctgtgccttcacccaagcgcaggtccccctgctccctctcggcgcccgcgggagtgtcgggggcctgcaggggagaagggagttggagatctgctttgcccctcctgcagcgctgccagcccggtgagcgctcggctgaaccccgcggcggtgtccaagtgacaacgcagcagcctcgcgcgtcctcctccgctccagccgtcacccccgagcaggacccagtgtcaccgccagacgcgcaaggagctacttacgttctcgcgccgcgccctccgctcagctctggcgcgactgcccaggaccctggaccgccggtgtcctccgttctcgacgaagctatcccctctggctgctccagccaggcggcccctgcgccgtcccccgcgcccgcgcgtctgaggctcggactgcggcgcgcgtccgccagcgaccctggcgaagcgaggctggccccgcgccggcgcgcgcccccgccgctcccgccctctccgctccccctccccgcgccgtgcttttgcccctcccggctctccttagcgtcctcccgtccccctcccccgcactccctgcgggcgtcctccgcctcctcccctcctggccaaccccctcttgccctgctgctgcgacggcagcgaatgggctccagccgccggcgcctcgagggactgggtggcccctcacctgagcggccgccccaccgccaacctccgtcagcctgcgagcgcgtgtggcggcgggggtgggggtgcggggacggagggcgggagtgttccggggctaggatggctgggatttagctacaaaagatgttccagaaaatgggtagtttttgaatgccactctcatgggtttagctttctgtgggaggtctgtggtcttctagttttttcttttttaaaaagcactttcttcgaaattcatcagttggggtggttgagattgggtgagtggttttgggggttttgttttgtttttgcaaccgttctttccaaacactccccgccgccccccaccaccgcagaaaaaagagcttttagcataaggcggatgctatctatccgcggtagaaactgggtcttctggtcccaaggaatagggttagttcggatttgcttatttacaaatgggggagtattatggagattttttttttttttttttggcaatgtaaatcgagaattaagattttccaactgtatagtatttgagtaaacacactgcttgctgcatagttcaggctccgaagcgcacgtctccactctatcgtggatggtgttca

SEQ ID NO: 128221 - DNA, 42 bp, Homo sapiens; identical to SEQ ID NO: 96194
  misc_feature 1..42: note = chr7:108164980-108165022
  misc_feature 1..42: note = Hypo
  source 1..42: mol_type = genomic DNA

SEQ ID NO: 128222 - DNA, 41 bp, Homo sapiens; identical to SEQ ID NO: 96195
  misc_feature 1..41: note = chr7:108165202-108165243
  misc_feature 1..41: note = Hypo
  source 1..41: mol_type = genomic DNA

SEQ ID NO: 128223 - DNA, 30 bp, Homo sapiens; identical to SEQ ID NO: 96196
  misc_feature 1..30: note = chr7:108168666-108168696
  misc_feature 1..30: note = Hypo
  source 1..30: mol_type = genomic DNA

SEQ ID NO: 128224 - DNA, 187 bp, Homo sapiens; identical to SEQ ID NO: 96198
  misc_feature 1..187: note = chr7:108503958-108504145
  misc_feature 1..187: note = Hypo
  source 1..187: mol_type = genomic DNA

SEQ ID NO: 128225 - DNA, 150 bp, Homo sapiens; identical to SEQ ID NO: 41434
  misc_feature 1..150: note = chr7:108515007-108515157
  misc_feature 1..150: note = Hypo
  source 1..150: mol_type = genomic DNA

SEQ ID NO: 128226 - DNA, 39 bp, Homo sapiens; identical to SEQ ID NO: 96203
  misc_feature 1..39: note = chr7:111560077-111560116
  misc_feature 1..39: note = Hypo
  source 1..39: mol_type = genomic DNA

SEQ ID NO: 128227 - DNA, 98 bp, Homo sapiens; identical to SEQ ID NO: 96204
  misc_feature 1..98: note = chr7:111560176-111560274
  misc_feature 1..98: note = Hypo
  source 1..98: mol_type = genomic DNA

SEQ ID NO: 128228 - DNA, 30 bp, Homo sapiens; identical to SEQ ID NO: 41435
  misc_feature 1..30: note = chr7:111662581-111662611
  misc_feature 1..30: note = Hypo
  source 1..30: mol_type = genomic DNA

SEQ ID NO: 128229 - DNA, 80 bp, Homo sapiens; identical to SEQ ID NO: 96207
  misc_feature 1..80: note = chr7:111844185-111844265
  misc_feature 1..80: note = Hyper
  source 1..80: mol_type = genomic DNA

SEQ ID NO: 128230 - DNA, 30 bp, Homo sapiens; identical to SEQ ID NO: 96208
  misc_feature 1..30: note = chr7:112220127-112220157
  misc_feature 1..30: note = Hypo
  source 1..30: mol_type = genomic DNA

SEQ ID NO: 128231 - DNA, 30 bp, Homo sapiens; identical to SEQ ID NO: 96209
  misc_feature 1..30: note = chr7:112429052-112429082
  misc_feature 1..30: note = Hypo
  source 1..30: mol_type = genomic DNA

SEQ ID NO: 128232 - DNA, 156 bp, Homo sapiens; identical to SEQ ID NO: 96210
  misc_feature 1..156: note = chr7:112431236-112431392
  misc_feature 1..156: note = Hypo
  source 1..156: mol_type = genomic DNA

SEQ ID NO: 128233 - DNA, 27 bp, Homo sapiens
  misc_feature 1..27: note = chr7:112726381-112726408
  misc_feature 1..27: note = Hyper
  source 1..27: mol_type = genomic DNA
ggtgttggatatcccgacagactatag

SEQ ID NO: 128234 - DNA, 86 bp, Homo sapiens
  misc_feature 1..86: note = chr7:112726528-112726614
  misc_feature 1..86: note = Hyper
  source 1..86: mol_type = genomic DNA
agggctcggcggcgcctgcgcgctggagcctccttgagctccagccgcgtcctcccctgtcgcagcggcaccgtctcccccagtaa

SEQ ID NO: 128235 - DNA, 141 bp, Homo sapiens; identical to SEQ ID NO: 96213
  misc_feature 1..141: note = chr7:112726853-112726994
  misc_feature 1..141: note = Hyper
  source 1..141: mol_type = genomic DNA

SEQ ID NO: 128236 - DNA, 1087 bp, Homo sapiens
  misc_feature 1..1087: note = chr7:113722696-113723783
  misc_feature 1..1087: note = Hyper
  source 1..1087: mol_type = genomic DNA
ttctaatttgtcattcgcgtgcgtcgctttccttcatcttggctatacttcctctcatctgcggtgttttatttcgcgcaagatgcgctgacagaggccatttcaaacgaatttatctttcactaggaccgtactagagcagtgtctcgaattttgttgatttgtggtttcgtcgtaaaataaacttgaaatcaaataaactttcgtgaggaagctttgatgtccacttggtgaaactcctcattcacccagttgagccgttgaactttcttctggaacctctttaaatgacttttgccgatccacgtgctgcaaagaagacctgaaccgtgcctatgaccctgcgcggcgactacagggacagaatttggctttccttctctttccaatatgcagcgtttcgtttaaaggctgcctcgatccagtgggctgaccagtgacttgtgcaaaagaaaactattcgatcgctgtttgccctttcagcgttttcctcggctgcggaaacccggttttcctattattatacttcaactttttttggagtcagctagcacagagcgctaaaccccggccagttccagcagcagccgaggcgaacaaagcctgcagtgttcggggccatgctggggcgggagtggtggacgagttcaaggaattgcaaataaatatattttatgaccacccatcaacaaactacgtgccaccgtggcggcccctggtagccgggccgtgtctgcagtgtggccaggggcgggggctgaaaaggaggcggccggagaggcgaagcgagctgcgagccccgggcctgaactttcacctctcgaacccgggcccagcccattggctgcagccgaggggtccaccgagggcagcggctcctgacaggacctgttttcccaactccctggacagcttccctgcgggatgggttggtggcccggggcatggcagcaggcgaggaggagataatgggggcgaagttgagcgggggcacttgggagctgcgggctcagtttcactgagaaaaaggccccggaagggtacgcgtccactctataaatatatactcctccgactgagatgtcct

SEQ ID NO: 128237 - DNA, 726 bp, Homo sapiens; identical to SEQ ID NO: 96216
  misc_feature 1..726: note = chr7:113724746-113725472
  misc_feature 1..726: note = Hyper
  source 1..726: mol_type = genomic DNA

SEQ ID NO: 128238 - DNA, 157 bp, Homo sapiens; identical to SEQ ID NO: 96217
  misc_feature 1..157: note = chr7:113725701-113725858
  misc_feature 1..157: note = Hyper
  source 1..157: mol_type = genomic DNA

SEQ ID NO: 128239 - DNA, 800 bp, Homo sapiens; identical to SEQ ID NO: 96218
  misc_feature 1..800: note = chr7:113726087-113726887
  misc_feature 1..800: note = Hyper
  source 1..800: mol_type = genomic DNA

SEQ ID NO: 128240 - DNA, 439 bp, Homo sapiens
  misc_feature 1..439: note = chr7:113727369-113727808
  misc_feature 1..439: note = Hyper
  source 1..439: mol_type = genomic DNA
gactgctgccttgatcgcgttcctttccctgtccacgcgttagcacgaccggcttcccccggtgtctggcctggttttacttttattccgctttagagaggtcgcctggctgtttgtgggtgggtttggggtgaaatcgcacctcgcggcacttggtgaggggacgtgggaggagcgcagacacctttcggtgatagggagggcttctcacttggctgttacctggaagtccacagtggccccggcgggcaggcgggcgggcagagcgcgggtccgaacgcccttcgcgctcgcggcggcgcacgtgcggcggcggcggcggcgccggcggcgcgggcgggacccactgggtggccgcgcgcgccacccgcgcgttttctgcgcgcctctgcccacccgcgaggccgcaacgcgccctgacacccgacctcagtgtgga

SEQ ID NO: 128241 - DNA, 1359 bp, Homo sapiens
  misc_feature 1..1359: note = chr7:114562155-114563514
  misc_feature 1..1359: note = Hyper
  source 1..1359: mol_type = genomic DNA
cccctttcccagccccgggagggcgcagcgcccgggtggggagcccgagccagcccaggccggctctggcctcctgacccagacagcgcagggcgcgagggatcgcgcggccgagcccgggtcgcgccgctcccagcatcggggccgctagccaagagttcgaggccttcccgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggaggtaggtagtggtctccgggcggggaagaggaggggtttgatccccatccccggggttctcccaaacccgatctctctttccagcccctccccgctgggtccacctcggacccctgggaccccgccgctgtcaacttgcgctgtaacagttttcttcgcaagtttcaaatcaaaacttccccggggtggagtttgagggagggaagtggagggggagggaacgtcccgcaggggtggtgtgctcttctctaaaaacatttttttttttaattttgtatatttttccgccagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtgagtgcgcgcttgcaagtggcaagcttctttgtcattgttgcatttttcagtttgctcacaagtgcacagataggggtggggggagtgctgtgaggaggggctcccactcgtagttgagaacttttgcacagttcgcgttactcaggcaagttcttcaggatccttgccctagatcaacaaccgggtaagagggcgggaaccgttggtccctccactcccccttcctttggttgcgaagaaacaggatgacaggattgcttctttcttaagcatatgcatgtttgggcctaagactcaatgtgtaggttctgaagcgcttctcctctagg

SEQ ID NO: 128242 - DNA, 475 bp, Homo sapiens; identical to SEQ ID NO: 96225
  misc_feature 1..475: note = chr7:115117435-115117910
  misc_feature 1..475: note = Hyper
  source 1..475: mol_type = genomic DNA

SEQ ID NO: 128243 - DNA, 43 bp, Homo sapiens; identical to SEQ ID NO: 96226
  misc_feature 1..43: note = chr7:115738426-115738469
  misc_feature 1..43: note = Hypo
  source 1..43: mol_type = genomic DNA

SEQ ID NO: 128244 - DNA, 327 bp, Homo sapiens
  misc_feature 1..327: note = chr7:116139864-116140191
  misc_feature 1..327: note = Hyper
  source 1..327: mol_type = genomic DNA
acagctcttcatggacgacgactcctacagccaccacagcggcctcgagtacgccgaccccgagaagttcgcggactcggaccaggaccgggatccccaccggctcaactcgcatctcaaggtgaagcccggggcgggcgggcccaagtccccgctgaggccgggaggtgcgggcgcccctcagccccgccctaacccgtcccaccattgctaccgggtcggccccgcagggtctgagacccgcacccttccccggtcccacccgtcaccaggccgcccgcgtagccaggaattcttagccaggttcctgtgcgcccaccgtgaccc

SEQ ID NO: 128245 - DNA, 30 bp, Homo sapiens; identical to SEQ ID NO: 96229
  misc_feature 1..30: note = chr7:116166712-116166742
  misc_feature 1..30: note = Hyper
  source 1..30: mol_type = genomic DNA

SEQ ID NO: 128246 - DNA, 92 bp, Homo sapiens; identical to SEQ ID NO: 96230
  misc_feature 1..92: note = chr7:116339527-116339619
  misc_feature 1..92: note = Hypo
  source 1..92: mol_type = genomic DNA

SEQ ID NO: 128247 - DNA, 44 bp, Homo sapiens; identical to SEQ ID NO: 96231
  misc_feature 1..44: note = chr7:116492603-116492647
  misc_feature 1..44: note = Hypo
  source 1..44: mol_type = genomic DNA

SEQ ID NO: 128248 - DNA, 30 bp, Homo sapiens; identical to SEQ ID NO: 96232
  misc_feature 1..30: note = chr7:116620287-116620317
  misc_feature 1..30: note = Hypo
  source 1..30: mol_type = genomic DNA

SEQ ID NO: 128249 - DNA, 30 bp, Homo sapiens; identical to SEQ ID NO: 96233
  misc_feature 1..30: note = chr7:116921667-116921697
  misc_feature 1..30: note = Hypo
  source 1..30: mol_type = genomic DNA

SEQ ID NO: 128250 - DNA, 2338 bp, Homo sapiens
  misc_feature 1..2338: note = chr7:116962402-116964740
  misc_feature 1..2338: note = Hyper
  source 1..2338: mol_type = genomic DNA
agcaaaatgttcttccgccccactggggtgaacctggaatgtggaaggacgggaaataatacaaagtcacacgctttaggttctacaactcctgactggctgaattggcccgtcgatttaccttgaggcagttttggcggggtgggggctgggatgggggaggcggttgtagttttcaaggtgaatttacacacacacacacacacacacacacacacacacacgtctgtgctagagctggagaccaggctagcacgtctctcaacaggataagaaattggctgattttgctgtcgctcagctggatccaaataaaccaaacatcggagctctcatttgagggggaatgtggttttatggagttgtcaaagctgaaatgatcttctgggaaaagagaaggggctcaccatggggcgataagagggcagtagccagggttcgggccagaatccgagactgctgcggccgcgggggaacgcagccaggaagggtctatgtggccaatgcggtccccattccgatctccaaaatcccccgcgcccgtgcgcgtggacttaccaccatgaagagttgacctcgggggtgagccaggtcaagagcagagggagccagagccagattccaccgagaggggcgttcatattaacccccttgcgtctgcatcaggtcagactccgtgtgcgggcgccatgcgtgcccagagcagaagcgctcagctccgggagcgcctcgtcacggccgccggcgcctcgccgcgcccccgccccccgctcgcgtctgcgacgagtggcgagactcgctgataaagtttcaaacgatgggcccagcgagcgataaaggccagcccggaccgcctcgcccacagcccaattccccaggcgcagcgagcgcctgcagcccgaaagctctgcgcgcctcccgcgcgccccgtccgctctgctcccctccgggcgcagccgagggagggggtgctgcgcctggcgggggtggggagaaacgcggggttttagacacgggtgcatgaaatgatggcaagagatgtctggggatgaggtgaggcggggaagggggaacatcgctgcatggttacgagcacacgcgaatacaggaacctttagggaagctccaggccaaagagcatccgtgggctctcggagcgtgcgttccggattgccgaggccatccgctggcaaacaagtccctgagcgtgcaatgtgaggaaacgaggaagggggccaggggataaggagattactatgcatgggatacaagaatccagagatgattctcaactcattgcttcgcttctctccctgaagctgggatgaagagctagcacttgtaaatttggagctgccgcgtctatgcagggcaaggttagggaggggccaggcctctgcgaaatgacctgttggctttgattccttggtgctgggcttaaatacagagcccatagggaggggaacttggagggtccatgaccctcgggacctaacccagcagtatctgccaaagcacccaggaaagatgcagtttttacgcacacccagctcctctccggagctgcggagcgcaaaagatcacatagagaggaaccgaggcagccaggcgttcgccgggggtgtgcgcccttgcacctcctgccgcctgggcgctcagcctgtgcgccttgtggaggttaagggaccctcggtcctggacctgggcccccgcccagccaagagagaggggcttgggcccgcgggtggagcattttgagcagtagctggcttgtagccgcgccgtttatcaccggaaaggaaggaagaccaggaactcgtggcggccgtgaactgttccattgctcttttcctggggcggagggactcactgcccgcccgaggagcgtgctctggggaatagagtatgcgcctgtgtgtatgtgtgggaggcgaattgttcgcagggcgtgggggagggggtgccgcccagatcggaaggacgggctctccctctctccagcccaccctcgggcctggactggccagagcgtcagccctcgccggcagcgagcgcggtgagaggctggacgaggcgaagctcagagacgccaaaaacctgaaagatgctgtcatcgccacccccttcccccacgctggtccctggcaggtccggcccctcccaggctgacccagatacatccccgtttgggtccggaaagggaggggagggaaacaagcaccgcgccacccacgactcgggaagagcagggctcctcgccagggccgctccgtatcgctgggccgcgacccagggaagttctgcttggtctgcgtcggtcgggcgggaggtgcaggga

SEQ ID NO: 128251 - DNA, 876 bp, Homo sapiens; identical to SEQ ID NO: 96236
  misc_feature 1..876: note = chr7:117119448-117120324
  misc_feature 1..876: note = Hyper
  source 1..876: mol_type = genomic DNA

SEQ ID NO: 128252 - DNA, 30 bp, Homo sapiens; identical to SEQ ID NO: 96237
  misc_feature 1..30: note = chr7:117433609-117433639
  misc_feature 1..30: note = Hypo
  source 1..30: mol_type = genomic DNA

SEQ ID NO: 128253 - DNA, 104 bp, Homo sapiens; identical to SEQ ID NO: 96238
  misc_feature 1..104: note = chr7:117512306-117512410
  misc_feature 1..104: note = Hyper
  source 1..104: mol_type = genomic DNA

SEQ ID NO: 128254 - DNA, 391 bp, Homo sapiens; identical to SEQ ID NO: 96239
  misc_feature 1..391: note = chr7:117512787-117513178
  misc_feature 1..391: note = Hyper
  source 1..391: mol_type = genomic DNA

SEQ ID NO: 128255 - DNA, 35 bp, Homo sapiens; identical to SEQ ID NO: 31483
  misc_feature 1..35: note = chr7:117513436-117513471
  misc_feature 1..35: note = Hyper
  source 1..35: mol_type = genomic DNA

SEQ ID NO: 128256 - DNA, 30 bp, Homo sapiens; identical to SEQ ID NO: 96241
  misc_feature 1..30: note = chr7:117805645-117805675
  misc_feature 1..30: note = Hypo
  source 1..30: mol_type = genomic DNA

SEQ ID NO: 128257 - DNA, 778 bp, Homo sapiens
  misc_feature 1..778: note = chr7:119912968-119913746
  misc_feature 1..778: note = Hyper
  source 1..778: mol_type = genomic DNA
ccttgaaccgggactcgagaggcagaagcaaggcacgggtcccctttctcctctcctccaccaaaccaccgcagcccagcacgtgaagcttccctttgttcatccgaggctcgcttttctccccagcagatccacctggatgctctccctcggtgacattttgcgccggggttggtgggtggctggggtggagcgagaggagcccgagggggcgggggcggagaaaggtcaagccgagggaaaggcaggagacgcctttcctaacctgcgtggcggggcgtgcgcgcggttatttatttattttctccttatttattgatcgcactagcagagcagcgcggggagcccggggagatgcaggaccacccactggcggggaagcagctagcagccctcccgcgcccccgcgctgccgagcgccttctgcctccgcgctcggacgagagcccgtgccggccccggccccggccccaccgcgccaacgccgcccgcccggccgccccgcagccccgccgccccgcagccccgcaccgcgctggccaggctcccgcgacagtggccccgcagtaagttggcaggagcgagtcccctccgttctcgcctcccccgcaccttttgaacttgttgctgctgctctgctcgcctgcgcctggcttttggaaggtgaaaaggaggagggaggcacggagggatgggggaagggaaagaagagctcgcttgagctttatttatgctctctcggcgcatcggattcggctgctcgcgagctgctttctct

SEQ ID NO: 128258 - DNA, 106 bp, Homo sapiens; identical to SEQ ID NO: 96245
  misc_feature 1..106: note = chr7:119913981-119914087
  misc_feature 1..106: note = Hyper
  source 1..106: mol_type = genomic DNA

SEQ ID NO: 128259 - DNA, 33 bp, Homo sapiens; identical to SEQ ID NO: 96246
  misc_feature 1..33: note = chr7:120368239-120368272
  misc_feature 1..33: note = Hypo
  source 1..33: mol_type = genomic DNA

SEQ ID NO: 128260 - DNA, 93 bp, Homo sapiens; identical to SEQ ID NO: 96247
  misc_feature 1..93: note = chr7:120969260-120969353
  misc_feature 1..93: note = Hyper
  source 1..93: mol_type = genomic DNA

SEQ ID NO: 128261 - DNA, 1092 bp, Homo sapiens
  misc_feature 1..1092: note = chr7:120969626-120970718
  misc_feature 1..1092: note = Hyper
  source 1..1092: mol_type = genomic DNA
gggcattgcctccttcggggttccagagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctttggctacgagctgagcagcggtgagtcctgggtccttaggggttggtgggggacggaaggcgacaactcctccaccggttcctgcaaataaagtaaatagtgctacgtggtcctgtagctctctaagttccagaagaagccctttagtgcacggggattgagagctacaaaggccagacctggggagcaggtgcgagcctggagggaggtgactccccagttccagagcggagctctaggggctggagctcttcctctttcctgcggtgccccgccagagttggaaaaaaaactctaattctcctaccccgccgaccccctcggaccccgtagcgcccccctacgtgggtgaccagctggagaaacatgatgtcggcagcggggaatgcggctgccgcatctgctttgatttaaccaactccgctgcgcaccaaaccccggacaagtggctaattgcagcgaagccccacctttattggctcctaggagcaccgagttgacagaataatggtgacttttaaagcgactgtccgcgaccacccaacgtgcggctaacctgagcaggaccacttgtgcgcttctcgtttctttggcttttctatctttccctcctcggcgcactcccgcggcgcgggaagctgcaggaaaacaaagttccacttccacgtgcgtagtgacttggtaaggataaaggtacagggagccaggattgttcctggaatatcaacagatccaaagaatgttaggactggggcgctgaaggatgcgctgtcgtttttcatgttcatttccgttccccctccgcctttgacccttgtccacgcagtccctgcgcgcacccccgccgagccgcgcacctcccccgcg

SEQ ID NO: 128262 - DNA, 149 bp, Homo sapiens; identical to SEQ ID NO: 96252
  misc_feature 1..149: note = chr7:121512756-121512905
  misc_feature 1..149: note = Hyper
  source 1..149: mol_type = genomic DNA

SEQ ID NO: 128263 - DNA, 405 bp, Homo sapiens; identical to SEQ ID NO: 96253
  misc_feature 1..405: note = chr7:121513553-121513958
  misc_feature 1..405: note = Hyper
  source 1..405: mol_type = genomic DNA

SEQ ID NO: 128264 - DNA, 774 bp, Homo sapiens; identical to SEQ ID NO: 96255
  misc_feature 1..774: note = chr7:121783508-121784282
  misc_feature 1..774: note = Hyper
  source 1..774: mol_type = genomic DNA

SEQ ID NO: 128265 - DNA, 138 bp, Homo sapiens; identical to SEQ ID NO: 96256
  misc_feature 1..138: note = chr7:121784548-121784686
  misc_feature 1..138: note = Hyper
  source 1..138: mol_type = genomic DNA

SEQ ID NO: 128266 - DNA, 1413 bp, Homo sapiens
  misc_feature 1..1413: note = chr7:121939677-121941090
  misc_feature 1..1413: note = Hyper
  source 1..1413: mol_type = genomic DNA
ggagctacttagggccgcatagattcggaatccagccaactatggaattccaagaccctcgctccctcgctttccgaagtcaaatctaacatggatttggccccaacagtgggcaaggtcggggcatgaggtcaggaaaggagaaacatcggttttcgatctaataatggctgggctggagcttgttccctgtgtccaaagggcgtgcgtactagcacaagcgttgagaaaggtctggacccgatgtctgcaggaagtgtcaggacctccctgttctggggaccttcccagcccacaccaggtccgtgctctctagattcccccaacctcgctccacaacccggaaggagctcaggccggacttggcgtgagggtccctgcggggctgggtcacctacccgtccgcgatcaccccacaggggctgttagtaatctccctgcttcctaggccgttgagaagcactcaggtcacccactctcggtgaccagagcggtcagtctttccccgccatgaaatgtgagttcgggtggcagccgccgcgcccctgcagtgtcccctgcacatctccggtctcggtctcgcctttctcagctccgcgccgccttttcctgggcgccgcaggactcatagaagtgaggcggggccacagatttaagtttattccccgcaactgtcggggcggtcccggagctggtgaggacgcgctacggtgggtgcagaaaggagatccctggactctgtagaacctgggcccgcggtgtggaccgatggtggattctccgcgacaacagccctggagggagagagtgggccgggggaggggccacggggcccctgaggcctgcggggctggccgcactggccccgggcctggcggggtggtggagtccgaagcggcgaggcgaggaccccggggcccgctccccccagtcgccctcccgggatgtggccccgctgcagtagcactacggtgctgggctgtttgtctggcagcttctactgagcagctaatagtataacaacccggctttgataaatctgaactaattacccctcttaattaaagtctttagcagttgtttcattgttttggcaagaaaacaggagagacgtgcagttagaaacaccagagcccgagctcacagcggagccgctgattaacacttgaagcatttcaaggacctggcacccgccacagtttggttttcatccatgtttcctccttgaatggaagtatattcgtctataaacatacatacacatgtaaaaacacggaggctccgtttgccagctgtgtacaagtcagtatgtgccgtcaggatgcaaacaatagatacctgtctatctatgattgtaatgcgtttgaggagatgtacattgcatacagctactggatacgttgttcccattta

SEQ ID NO: 128267 - DNA, 510 bp, Homo sapiens; identical to SEQ ID NO: 96259
  misc_feature 1..510: note = chr7:121941881-121942391
  misc_feature 1..510: note = Hyper
  source 1..510: mol_type = genomic DNA

SEQ ID NO: 128268 - DNA, 736 bp, Homo sapiens
  misc_feature 1..736: note = chr7:121943656-121944392
  misc_feature 1..736: note = Hyper
  source 1..736: mol_type = genomic DNA
gaaggaaaggatctccgttttgcattgtacttgcctttccacacacttcgcaagtgaaaactttgggcttggcattaggagagcctcggctgaaatccgaggttttgaacgcgattttttccgacagaagctgggcgctttctttcatgtaatgctgcagctgagcctgggacaggtctttgaaagctactccagaagggtatttctccaccgccgggaccaccagtttattcctttcggctaaatacgtttttggctgcgggtgcaaaggggaactgaggaagtaggaggccaccgggtggatgttcacgccggctgccgggtggcatgggccgtcacctcggttcaggtagcacaaggcgcccatggcgtggaatgaagagtggttgaccacacgcggccttaccagcttgtactgctgcagcggcagcgcgtcgcgggccaggtcgcccttgagactcagtgcgcagttgagcaggtcgctgcagctgaatgcgggagccgagggcaccgccgcgggcgccgccggggcctccagactggccttccgcggctcggagcccgtcactcctgccttggggctcgtgtcgtaggccacaggcacgaaggggatcatgcaggggatcgacgagttgagatgcagagagtgcttgggttcccccttgggtaaggctccctgcaggaagtgggggactggcagggccttgggctctggggtgcgcgccatgattcgttc

SEQ ID NO: 128269 - DNA, 30 bp, Homo sapiens; identical to SEQ ID NO: 31498
  misc_feature 1..30: note = chr7:121944621-121944651
  misc_feature 1..30: note = Hyper
  source 1..30: mol_type = genomic DNA

SEQ ID NO: 128270 - DNA, 535 bp, Homo sapiens; identical to SEQ ID NO: 96263
  misc_feature 1..535: note = chr7:121945611-121946146
  misc_feature 1..535: note = Hyper
  source 1..535: mol_type = genomic DNA

SEQ ID NO: 128271 - DNA, 1077 bp, Homo sapiens
  misc_feature 1..1077: note = chr7:121946372-121947449
  misc_feature 1..1077: note = Hyper
  source 1..1077: mol_type = genomic DNA
caagtgtagtgggggcgtccttctgctagagctctgaaaagggttggccccggaaggctggataacggcggactagaaaccctggcattattaagtccctgagcaatttcactcaaagatgcgaaactggaccttaaacgaaggaaattgacgtcaaagtattccctcctctctaccccattctcaacacatgccaggcaagctacccgggtccctccgccccactctaactttccgcgaaaatcagttccgcctctgccccaagagccaagaggggtggaaaggaagagagcttgggctgggaacgcgcctgatgtctaacagaaaggcagtggcagctgggtgagtggtgggaaagctcacaggctgaagaaatgggggagggggagtgagtcttattggaagttgaggacagccaaggggcaagatggggggagaggtctggctgaatacgacgggcttcagcagctaggcctgggagtgcctcgtttcaggcctcgaggtggcttcaggctgggacaactgatgcagcagagaagggcagagcgcccggggggagaaagcaaagaggcgctacactccaaggcggccctttggaaccgtccttggcccgggtgcacctactttggattcgcccagactgcaaatttttctttccttttgctggggccacgggacagagcacctgggcagagcaagcggagaggcgccacatccccgagaggcgcttcgtagttgtccttggaccgggcgcagacactcagtattggtcagcgctggaaattttctttccttttgctgttggggccgcagaaccagtctcctcctttcccctgctcagacaaagggcacgggaagggctttgctggggcaaaggggggtggggggttctctgtcccacgacagatgggtcgcggttaagactttaattgctgacttttgggccggatcagattccttttcctacctgccacttcccagcagcgaaaaatccccctcctgctgcactcctccgccaccgggctaggttgaaaggaaaaagccaagaagcgcgaagcagcccggctctggaaggct

SEQ ID NO: 128272 - DNA, 902 bp, Homo sapiens
  misc_feature 1..902: note = chr7:121950038-121950940
  misc_feature 1..902: note = Hyper
  source 1..902: mol_type = genomic DNA
ccttgacactacccacgaagtttaaagcattttttatgttattttcaaactttcttaagtgatcccatgaaataaaagtcgataatagaaattaaaacaacacagagcaaagaacgagcttagtgaaatggagaagcagtagaggtaaataaaaatcctcgagctagaaagctctaagaaccgcttataaattcagttacctcctgaactccggccgatggccactccggcccgggagtgccccgcgccgacccgctggccttggccgtctcagccttcattatcgccacggccttggcgccccctgcccccggctgcccaggggaaccaagttcccgctgctggagttggggcagaggagccccgcctcattcaggattcggtggccagcgcagagccatttgaatagaagaagcccgaagtgaaacagaaaagctgaaaactccccggctgggctctccacttctcggttcttgctcacgagttccaaacagttaaagtgacgttggcaaggccgagggccaccgagctctgtgagactcccttggaggggtcaggaaacttagctcgagaagcttggaggcggctgggagttggggcgcaacttcagtgaccgggcgccgctgccgggctggggctcccaagcgtccggctcccggggtggtcgacgcggcgctgccttcgatcaggtcccgccgacctcgggcctctggaccaccaccgccccagctggtctggcaacccatcccgggcgcaatcgcgctcctccccttctcctctgcattcccgcaggtcctggggcggctccatccccccaaggctgagagatggcgagggaggctccaaagagtttcgggagggggcgccggatctggtttaagagaccgcggaacagatggtgg

SEQ ID NO: 128273 - DNA, 306 bp, Homo sapiens
  misc_feature 1..306: note = chr7:121951863-121952169
  misc_feature 1..306: note = Hyper
  source 1..306: mol_type = genomic DNA
ggctcctggaaacaacgcgaagctttaagcgccccgcgcgggtgttgacgctggcagctcgcaaacagcgtcccgcggccacggtgacccgaggggccggccggctgacgtcacgaacgcggccagctgcggggacccgggctgcaaccgcggcctctggcccctgccttctcgttgggtcgagggtgggaagggaagttgaggtctggggtaaaaagccggaaaaagaaaggaacaaggctgagaatcattcaaagattaaatggggtcggctcccgttgcttgcgaagacggatgaggagggag

SEQ ID NO: 128274 - DNA, 45 bp, Homo sapiens; identical to SEQ ID NO: 96270
  misc_feature 1..45: note = chr7:121955270-121955315
  misc_feature 1..45: note = Hyper
  source 1..45: mol_type = genomic DNA

SEQ ID NO: 128275 - DNA, 465 bp, Homo sapiens; identical to SEQ ID NO: 96271
  misc_feature 1..465: note = chr7:121955375-121955840
  misc_feature 1..465: note = Hyper
  source 1..465: mol_type = genomic DNA

SEQ ID NO: 128276 - DNA, 78 bp, Homo sapiens; identical to SEQ ID NO: 96272
  misc_feature 1..78: note = chr7:121956177-121956255
  misc_feature 1..78: note = Hyper
  source 1..78: mol_type = genomic DNA

SEQ ID NO: 128277 - DNA, 873 bp, Homo sapiens
  misc_feature 1..873: note = chr7:121956458-121957331
  misc_feature 1..873: note = Hyper
  source 1..873: mol_type = genomic DNA
tccccatcttcaatccgaagctggggtatcccagagaaagtctcgctctgagctcctgctggggcacctgcccagccatgcccctcgagggcgtcgctgctctcaacccctctccgctactgcccggccgcccaggcctgtggacgcgactccatctgtagcaaagttcgggggccaaatgggtcgcggctcttcctcgaaggttactgcgagcgggacttgaagggaaaaggaggcgcattagcgacttcgttttcttgcatagtactggtacagagtaccggtgatggtcgtaggggaactctatgtaaagactggatgaccaccggcctcccggaaaccccacacgccaggcctccaacttcttcacaaaagtggggtgggtggcggagggctgtggcgggggcttggagctgctgagagccgagaggcgcagagcgcaagctggcaggctgggctgctatcccggcgcgcagatgccccgccgccagtcgagcgcgaacatctctccggaacatcgatctatcacctccctttaaggacccggaccgggaaatttccattttctgttttgggaataagaaataaaagcgaccaagctcttgccctaatttccccccgcgggcccttccacgcgggctggcgggatcagaaggacgggtccgagctcgggggcgcggggttcctgtgaactccgggcttgctcggtccggtccccgcgcctgctgtccccaggccctctcgggaggcagaccgcggcagcgcaaaggggcttcgaggatctctgagcaacgacggctgagtgacctctttccctctcaagcacaccttcaaggagccggtggaccctctcaccgccggtagctgcaggct

SEQ ID NO: 128278 - DNA, 314 bp, Homo sapiens; identical to SEQ ID NO: 96279
  misc_feature 1..314: note = chr7:123172930-123173244
  misc_feature 1..314: note = Hyper
  source 1..314: mol_type = genomic DNA

SEQ ID NO: 128279 - DNA, 16 bp, Homo sapiens
  misc_feature 1..16: note = chr7:123175665-123175681
  misc_feature 1..16: note = Hypo
  source 1..16: mol_type = genomic DNA
agagtcttgctctgtc

SEQ ID NO: 128280 - DNA, 30 bp, Homo sapiens; identical to SEQ ID NO: 96281
  misc_feature 1..30: note = chr7:123259499-123259529
  misc_feature 1..30: note = Hypo
  source 1..30: mol_type = genomic DNA

SEQ ID NO: 128281 - DNA, 1007 bp, Homo sapiens; identical to SEQ ID NO: 96282
  misc_feature 1..1007: note = chr7:123672016-123673023
  misc_feature 1..1007: note = Hyper
  source 1..1007: mol_type = genomic DNA

SEQ ID NO: 128282 - DNA, 157 bp, Homo sapiens; identical to SEQ ID NO: 31517
  misc_feature 1..157: note = chr7:123673226-123673383
  misc_feature 1..157: note = Hyper
  source 1..157: mol_type = genomic DNA

SEQ ID NO: 128283 - DNA, 856 bp, Homo sapiens
  misc_feature 1..856: note = chr7:124404361-124405217
  misc_feature 1..856: note = Hyper
  source 1..856: mol_type = genomic DNA
tccattctgggccagcgcccggcccgggagtgcaattgtccacccttcgtgccccgccagtccattggccgtcttggacaggggcttgtggtgggaaccctggagtttcccggctctccttggccagtaaaaaagatcgctggctccggggactgtcttcacactctgctcctggctacgcccggaaatgccagcgcctctgggacccttctcttcctcctctgagatctgaaggaagagctggagggccgtggggttccctctccccaaagtttcagaaggctcctgaccccgagcacctttccacctccaggggccaggtggcctggttggaggtcccgggggtccggctgccgacgcctccgcccctctgcctgcagccgggtcacggcccggggccgccggcaggtcccaggagggtcccgcaagaaacgctgccccctgctcctccctgggtgctcgggctcgcagaacgtctcttgcagaatttcccggtccccaggcgtccctgccgcggcgctggatcactgtaggtgcacagctctcccccagacaagtttcgtttctggacgcaggggcgaccccgagggcagaagaggcagacaccttgagcagtagcagaagcagtagccgcgacatgcgggcgagaagcgcgcccggggctcgcatggcttggtgagggcacacccggcagccgcagctcctgcttagttaggatcgacacctgctgccgaagttgctgctgagagttaggcacatgtcacatactcacccccgcccgggtagcggggaaccggagattagggtgatagcggaagatcggtcttgggggtcacacacacgccccctataatcc

SEQ ID NO: 128284 - DNA, 671 bp, Homo sapiens; identical to SEQ ID NO: 31521
  misc_feature 1..671: note = chr7:124405556-124406227
  misc_feature 1..671: note = Hyper
  source 1..671: mol_type = genomic DNA

SEQ ID NO: 128285 - DNA, 35 bp, Homo sapiens; identical to SEQ ID NO: 96292
  misc_feature 1..35: note = chr7:126325948-126325983
  misc_feature 1..35: note = Hypo
  source 1..35: mol_type = genomic DNA

SEQ ID NO: 128286 - DNA, 2032 bp, Homo sapiens; identical to SEQ ID NO: 96295
  misc_feature 1..2032: note = chr7:126891206-126893238
  misc_feature 1..2032: note = Hyper
  source 1..2032: mol_type = genomic DNA

SEQ ID NO: 128287 - DNA, 47 bp, Homo sapiens; identical to SEQ ID NO: 96296
  misc_feature 1..47: note = chr7:126893442-126893489
  misc_feature 1..47: note = Hyper
  source 1..47: mol_type = genomic DNA

SEQ ID NO: 128288 - DNA, 214 bp, Homo sapiens
  misc_feature 1..214: note = chr7:126987739-126987953
  misc_feature 1..214: note = Hyper
  source 1..214: mol_type = genomic DNA
ggctcaaaccagggacggcgagggcaaggggtgaaaggggtttgaggcgaggcagaggactcaggggtctgcggacggctggtcggcccgtggagacggccgcggcgaggcgcctgaggtacggcggtgcggagcgagggcgaggtcccgccggcggccaggcggcggcgctcacggagccgcgggcttccccaggccccgggcagcgtgctgg

SEQ ID NO: 128289 - DNA, 49 bp, Homo sapiens; identical to SEQ ID NO: 96300
  misc_feature 1..49: note = chr7:126988157-126988206
  misc_feature 1..49: note = Hyper
  source 1..49: mol_type = genomic DNA

SEQ ID NO: 128290 - DNA, 206 bp, Homo sapiens; identical to SEQ ID NO: 96302
  misc_feature 1..206: note = chr7:127061193-127061399
  misc_feature 1..206: note = Hypo
  source 1..206: mol_type = genomic DNA

SEQ ID NO: 128291 - DNA, 100 bp, Homo sapiens; identical to SEQ ID NO: 96306
  misc_feature 1..100: note = chr7:127253534-127253634
  misc_feature 1..100: note = Hypo
  source 1..100: mol_type = genomic DNA

SEQ ID NO: 128292 - DNA, 181 bp, Homo sapiens; identical to SEQ ID NO: 96307
  misc_feature 1..181: note = chr7:127260532-127260713
  misc_feature 1..181: note = Hyper
  source 1..181: mol_type = genomic DNA

SEQ ID NO: 128293 - DNA, 30 bp, Homo sapiens; identical to SEQ ID NO: 41439
  misc_feature 1..30: note = chr7:127371129-127371159
  misc_feature 1..30: note = Hypo
  source 1..30: mol_type = genomic DNA

SEQ ID NO: 128294 - DNA, 30 bp, Homo sapiens; identical to SEQ ID NO: 96316
  misc_feature 1..30: note = chr7:127615921-127615951
  misc_feature 1..30: note = Hypo
  source 1..30: mol_type = genomic DNA

SEQ ID NO: 128295 - DNA, 653 bp, Homo sapiens
  misc_feature 1..653: note = chr7:127744057-127744710
  misc_feature 1..653: note = Hyper
  source 1..653: mol_type = genomic DNA
atgaagaaactgagccgaggaaaggaagcgacttggccaaggtcggagagctcattctttgcagggcggggtttggaacccggggtctggctctcggcaacgcgccctcggcccgcagcctcctgccccctgtgccccgcttcggcccccagcgcagctgcagaggggcccccctcgacgcatacactcaagagcccgaccgcgcggctgaaatcgcggagctcggagccgcggctggctgagcgatcgcggttcctgggctgcgtgcgcgccccttggagctgaaaggagcgccaggatcgggggcgctgcaccgggctgggcccctcaacgctcgcagaccgggccgggctgcagctggagatggcagcaatcccgggaggtctccgggcctcttcagggtgcgtccaggaggcgggttccgtgcgacgcggcgcagcccacccccacgagaccgcttaacttcgcgggggcagcctcgggcgctcggagacgcggaggcccagactgcagcctccggatgctggaagcccagactccctggggtcaccggctctcccgccaccccagctgcaaagagtcccattgcttcaccgtccggagcttagtctccttgttcctctaccagtccctccctccgcaggtctctgggg

SEQ ID NO: 128296 - DNA, 141 bp, Homo sapiens; identical to SEQ ID NO: 96322
  misc_feature 1..141: note = chr7:127776269-127776410
  misc_feature 1..141: note = Hyper
  source 1..141: mol_type = genomic DNA

SEQ ID NO: 128297 - DNA, 897 bp, Homo sapiens; identical to SEQ ID NO: 96324
  misc_feature 1..897: note = chr7:127806266-127807163
  misc_feature 1..897: note = Hyper
  source 1..897: mol_type = genomic DNA

SEQ ID NO: 128298 - DNA, 1247 bp, Homo sapiens; identical to SEQ ID NO: 96325
  misc_feature 1..1247: note = chr7:127807478-127808725
  misc_feature 1..1247: note = Hyper
  source 1..1247: mol_type = genomic DNA

SEQ ID NO: 128299 - DNA, 648 bp, Homo sapiens
  misc_feature 1..648: note = chr7:127841202-127841850
  misc_feature 1..648: note = Hyper
  source 1..648: mol_type = genomic DNA
tttacagttaaaaggcgttagcgctggcctttgagacagactcactgagccacccaaggtcacccgggcagcgggcacagttgggactgaacgcaggggctctacctgtgccaggtgtccacacctcggtggcgctcggccgcctgacctcctcttggagttcccggctcagggcagggggtcgcgtccctgcggtctctggaggccacgccccacccgggcccaccggggtgggcgtggctacgtggctccctggcgctgaggcgcctccttcccaggtgggcggggctcctgccgggtcggttcccgcaggctgcccgcggaccccagccacttggccaggctgcagggacagtgcgaggaggcgctcagcctggaccacagcggaggtgtgcaggactcagcgaggcccccaagcttgtacgcctccttcctccgccggcttctctgtctgcctcccactgtccctattctgcccttcacagatcgttgtcattatcaagtcctacactttgagagcagaaaacgaccccgtacgtggtgggtctccgacatctgtttattacgttggaccgcatgctgcatatgatccagccacctcgctctactcctgtggctgcccttcgtcctcgtcgccgggacccctct

SEQ ID NO: 128300 - DNA, 30 bp, Homo sapiens; identical to SEQ ID NO: 96331
  misc_feature 1..30: note = chr7:127982386-127982416
  misc_feature 1..30: note = Hypo
  source 1..30: mol_type = genomic DNA

SEQ ID NO: 128301 - DNA, 890 bp, Homo sapiens
  misc_feature 1..890: note = chr7:127991661-127992551
  misc_feature 1..890: note = Hyper
  source 1..890: mol_type = genomic DNA
gcagcagcggagccgcgtggcccggggacaagcggaagagcttggcccagcagcgcggcggcacgcgaggactgcagagcgccgggtagaggcccagcagcgccaacgggagcgcgacgcccacctcgcccaggcgcaggcctagctggaaggcccaccagggccagggcccttccaggccggattggccgccgtagcccagggcgtgcagcacctcatagccctgcagggctccgctcagcagcccgaaggtgcccgccaccggggccgtgcgcgccgcgcgccgccaggactcccgaggggcgaaggggctgcgcccctgcggcaggggtgtggcgcccttgaagcccgaccctcccaggggcgccccggcccgccgccgccgcccgccccagcaggagagcgccagcagcagcccggaaaggaaagcggcgagaaaggcgtgcagcccgcgcgaggcgagccgcaggggccgcagcgggcgatgcgcggcgctcccgagggcggcggcggccgccagccccagccccaggagcagcagcgcagccaggccggtggggcaccgcggcgggcgcggccgggccagcagcaggcaggccagccccaggccggcagccaagcagggcagcggaaggtcctgcagcagcagccaggcgagcgcgggcagtcgatccctgtgcccataggcgtcgtagaagagcgggaaggcccgcgtggtcccggccgacagcagcagcaggtccagcagcgccaggcagggggcgccgggcgggcaccgccagggcaagagggccagagccagcagcgccagcaaggcaaccaggccgaagagcgcgcctaccccgtacacgtgggcctcccaggccagcccccagcgagccctggcctct

SEQ ID NO: 128302 - DNA, 49 bp, Homo sapiens
  misc_feature 1..49: note = chr7:128000972-128001021
  misc_feature 1..49: note = Hyper
  source 1..49: mol_type = genomic DNA
catagccacatctagcgcccgtgacacactcacccgtcacatacccccc

SEQ ID NO: 128303 - DNA, 157 bp, Homo sapiens; identical to SEQ ID NO: 96338
  misc_feature 1..157: note = chr7:128002255-128002412
  misc_feature 1..157: note = Hyper
  source 1..157: mol_type = genomic DNA

SEQ ID NO: 128304 - DNA, 102 bp, Homo sapiens; identical to SEQ ID NO: 41440
  misc_feature 1..102: note = chr7:128096987-128097089
  misc_feature 1..102: note = Hypo
  source 1..102: mol_type = genomic DNA

SEQ ID NO: 128305 - DNA, 101 bp, Homo sapiens; identical to SEQ ID NO: 96341
  misc_feature 1..101: note = chr7:128097589-128097690
  misc_feature 1..101: note = Hypo
  source 1..101: mol_type = genomic DNA

SEQ ID NO: 128306 - DNA, 23 bp, Homo sapiens
  misc_feature 1..23: note = chr7:128126053-128126076
  misc_feature 1..23: note = Hypo
  source 1..23: mol_type = genomic DNA
aagaaaagcacaggccgggcgtg

SEQ ID NO: 128307 - DNA, 103 bp, Homo sapiens; identical to SEQ ID NO: 41442
  misc_feature 1..103: note = chr7:128315917-128316020
  misc_feature 1..103: note = Hypo
  source 1..103: mol_type = genomic DNA

SEQ ID NO: 128308 - DNA, 138 bp, Homo sapiens; identical to SEQ ID NO: 31541
  misc_feature 1..138: note = chr7:128337405-128337543
  misc_feature 1..138: note = Hyper
  source 1..138: mol_type = genomic DNA

SEQ ID NO: 128309 - DNA, 318 bp, Homo sapiens
  misc_feature 1..318: note = chr7:128337603-128337921
  misc_feature 1..318: note = Hyper
  source 1..318: mol_type = genomic DNA
gtaggtttttggcttcccgctccctctctctttcccccttttgtcgccgcgcttttcaaccgccccctaactctgctcccccttttactccgtcgcagcccgggacctcctggtgggggtccgccactgcagcaccaggcgccactgccataccaccctgaacgcgcccgatctcgtctgatctcggaagctaagatgtggccgcatttaggaccccaccggcttggctgtgcctctcccagccccctggcggagcggactaaccctagcatttcattgattcacaataacgccaccccaccccgactgactattttg

SEQ ID NO: 128310 - DNA, 247 bp, Homo sapiens
  misc_feature 1..247: note = chr7:128430709-128430956
  misc_feature 1..247: note = Hyper
  source 1..247: mol_type = genomic DNA
agagtgaacatcagtcgtgcccactctgagcgggctactgtgggggcgtggctcgcagcccaccgggtgtgggaccggaagggaagacagggcggaggagagggggtcttccggccctgaggcttgatggggccaccggagggctcctcctaagagggtccttggccctggctcggtggggggtcgcggaaagcggagaggtcagggccctgccgttcgcccatccgggcctcgacttccctcctcc

SEQ ID NO: 128311 - DNA, 846 bp, Homo sapiens
  misc_feature 1..846: note = chr7:128470433-128471279
  misc_feature 1..846: note = Hyper
  source 1..846: mol_type = genomic DNA
ttaaaccccccgccccggcccagcccgcccttcccgagcaccgctccggccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccataggtcagtgccgggggcgagggcacgggcgctgcggggatagggtcgtcccatggggcaggggcacaggtgcggggtgggcgcgcggggagctgagagacagggcggagggcaccccccggtatagagagaagaccctggccccggccctcccacccatcgacaagggccatgggcactgcctgcacacccctctggggacagcgagcactccctgggtgccccggggagtccaggcc

SEQ ID NO: 128312 - DNA, 30 bp, Homo sapiens; identical to SEQ ID NO: 96354
  misc_feature 1..30: note = chr7:128481374-128481404
  misc_feature 1..30: note = Hypo
  source 1..30: mol_type = genomic DNA

SEQ ID NO: 128313 - DNA, 30 bp, Homo sapiens; identical to SEQ ID NO: 96355
  misc_feature 1..30: note = chr7:128482220-128482250
  misc_feature 1..30: note = Hyper
  source 1..30: mol_type = genomic DNA

SEQ ID NO: 128314 - DNA, 106 bp, Homo sapiens; identical to SEQ ID NO: 96356
  misc_feature 1..106: note = chr7:128482943-128483049
  misc_feature 1..106: note = Hypo
  source 1..106: mol_type = genomic DNA

SEQ ID NO: 128315 - DNA, 50 bp, Homo sapiens; identical to SEQ ID NO: 96357
  misc_feature 1..50: note = chr7:128484931-128484981
  misc_feature 1..50: note = Hypo
  source 1..50: mol_type = genomic DNA

SEQ ID NO: 128316 - DNA, 142 bp, Homo sapiens; identical to SEQ ID NO: 96358
  misc_feature 1..142: note = chr7:128486098-128486240
  misc_feature 1..142: note = Hypo
  source 1..142: mol_type = genomic DNA

SEQ ID NO: 128317 - DNA, 128 bp, Homo sapiens; identical to SEQ ID NO: 96359
  misc_feature 1..128: note = chr7:128493102-128493230
  misc_feature 1..128: note = Hypo
  source 1..128: mol_type = genomic DNA

SEQ ID NO: 128318 - DNA, 30 bp, Homo sapiens; identical to SEQ ID NO: 96360
  misc_feature 1..30: note = chr7:128494242-128494272
  misc_feature 1..30: note = Hypo
  source 1..30: mol_type = genomic DNA

SEQ ID NO: 128319 - DNA, 30 bp, Homo sapiens; identical to SEQ ID NO: 96361
  misc_feature 1..30: note = chr7:128507583-128507613
  misc_feature 1..30: note = Hypo
  source 1..30: mol_type = genomic DNA

SEQ ID NO: 128320 - DNA, 120 bp, Homo sapiens; identical to SEQ ID NO: 96362
  misc_feature 1..120: note = chr7:128510078-128510198
  misc_feature 1..120: note = Hyper
  source 1..120: mol_type = genomic DNA

SEQ ID NO: 128321 - DNA, 40 bp, Homo sapiens; identical to SEQ ID NO: 96363
  misc_feature 1..40: note = chr7:128525170-128525210
  misc_feature 1..40: note = Hypo
  source 1..40: mol_type = genomic DNA

SEQ ID NO: 128322 - DNA, 389 bp, Homo sapiens; identical to SEQ ID NO: 96364
  misc_feature 1..389: note = chr7:128528743-128529132
  misc_feature 1..389: note = Hypo
  source 1..389: mol_type = genomic DNA

SEQ ID NO: 128323 - DNA, 156 bp, Homo sapiens; identical to SEQ ID NO: 96365
  misc_feature 1..156: note = chr7:128531803-128531959
  misc_feature 1..156: note = Hypo
  source 1..156: mol_type = genomic DNA

SEQ ID NO: 128324 - DNA, 41 bp, Homo sapiens; identical to SEQ ID NO: 96366
  misc_feature 1..41: note = chr7:128532991-128533032
  misc_feature 1..41: note = Hypo
  source 1..41: mol_type = genomic DNA

SEQ ID NO: 128325 - DNA, 30 bp, Homo sapiens; identical to SEQ ID NO: 41449
  misc_feature 1..30: note = chr7:128533290-128533320
  misc_feature 1..30: note = Hypo
  source 1..30: mol_type = genomic DNA

SEQ ID NO: 128326 - DNA, 121 bp, Homo sapiens
  misc_feature 1..121: note = chr7:128550406-128550527
  misc_feature 1..121: note = Hyper
  source 1..121: mol_type = genomic DNA
agccgcactctctcccgccgccggctgcaggaaccgcccccctctcctgaaccccctgctttggccgtggtcttccccaccctgctcgctcccccgacggggaggacggagctggccaggg

SEQ ID NO: 128327 - DNA, 30 bp, Homo sapiens; identical to SEQ ID NO: 96368
  misc_feature 1..30: note = chr7:128555645-128555675
  misc_feature 1..30: note = Hyper
  source 1..30: mol_type = genomic DNA

SEQ ID NO: 128328 - DNA, 18 bp, Homo sapiens
  misc_feature 1..18: note = chr7:128718421-128718439
  misc_feature 1..18: note = Hypo
  source 1..18: mol_type = genomic DNA
acccggccaagaaacttt

SEQ ID NO: 128329 - DNA, 37 bp, Homo sapiens; identical to SEQ ID NO: 96374
  misc_feature 1..37: note = chr7:128767772-128767809
  misc_feature 1..37: note = Hypo
  source 1..37: mol_type = genomic DNA

SEQ ID NO: 128330 - DNA, 536 bp, Homo sapiens; identical to SEQ ID NO: 96376
  misc_feature 1..536: note = chr7:128828104-128828640
  misc_feature 1..536: note = Hyper
  source 1..536: mol_type = genomic DNA

SEQ ID NO: 128331 - DNA, 475 bp, Homo sapiens; identical to SEQ ID NO: 31549
  misc_feature 1..475: note = chr7:128828904-128829379
  misc_feature 1..475: note = Hyper
  source 1..475: mol_type = genomic DNA

SEQ ID NO: 128332 - DNA, 99 bp, Homo sapiens; identical to SEQ ID NO: 96380
  misc_feature 1..99: note = chr7:129142801-129142900
  misc_feature 1..99: note = Hyper
  source 1..99: mol_type = genomic DNA

SEQ ID NO: 128333 - DNA, 27 bp, Homo sapiens
  misc_feature 1..27: note = chr7:129229604-129229631
  misc_feature 1..27: note = Hypo
  source 1..27: mol_type = genomic DNA
agtcaccgcgcccggccagtcttttct

SEQ ID NO: 128334 - DNA, 30 bp, Homo sapiens; identical to SEQ ID NO: 41451
  misc_feature 1..30: note = chr7:129297274-129297304
  misc_feature 1..30: note = Hypo
  source 1..30: mol_type = genomic DNA

SEQ ID NO: 128335 - DNA, 57 bp, Homo sapiens; identical to SEQ ID NO: 96383
  misc_feature 1..57: note = chr7:129330294-129330351
  misc_feature 1..57: note = Hypo
  source 1..57: mol_type = genomic DNA

SEQ ID NO: 128336 - DNA, 258 bp, Homo sapiens; identical to SEQ ID NO: 41453
  misc_feature 1..258: note = chr7:129381062-129381320
  misc_feature 1..258: note = Hypo
  source 1..258: mol_type = genomic DNA

SEQ ID NO: 128337 - DNA, 30 bp, Homo sapiens; identical to SEQ ID NO: 96385
  misc_feature 1..30: note = chr7:129407651-129407681
  misc_feature 1..30: note = Hypo
  source 1..30: mol_type = genomic DNA

SEQ ID NO: 128338 - DNA, 391 bp, Homo sapiens
  misc_feature 1..391: note = chr7:129418271-129418662
  misc_feature 1..391: note = Hyper
  source 1..391: mol_type = genomic DNA
attttctcttctttgcgtaaggccgactccagaggtcccgctaactcccccgcaggagcatgaaggggcggccttgagcggtaaagaaacgagcagtggtggaggctgccgctccgagcccaggtccgaaccgagagccgcgcggggaatgtgggggtcgaggctgagagctgggcttggggcaggttcctttgcgttcgctcaggccacgatgaggccactaggacagatttctccgaaggctcggcctcggatcagagatccgccgactcggtgcccatcggtcgggctcactgggtgacaggtagagggtgatgcgcacccgtagagctgagtgacccggcccgagaatccgccacctggctcgcaggattttcgccctcaggagctt

SEQ ID NO: 128339 - DNA, 65 bp, Homo sapiens; identical to SEQ ID NO: 96387
  misc_feature 1..65: note = chr7:129421284-129421349
  misc_feature 1..65: note = Hyper
  source 1..65: mol_type = genomic DNA

SEQ ID NO: 128340 - DNA, 1852 bp, Homo sapiens
  misc_feature 1..1852: note = chr7:129421630-129423482
  misc_feature 1..1852: note = Hyper
  source 1..1852: mol_type = genomic DNA
ggctgtctctgcacccgcgccctacctggtcctcagacccatgcgatgctgggcaacccgggccgggtgtgcccaggaccgcaaagcgggaagcgcaggccttgcggactgcgagtggcccccgcggcctgctgctcccctttataacgcgcgccccgccccccgcgctccgggcgccccgccctggcccattcacctgctgtcgagaaccagacaccgcgcagcagaaagctagccgctgggccgcgaggtccggccgtcggagcgggcggggctggggcgccgccgagacagatccgatttccaccttttcttaaatgcgctgctgaaagtcgagaaggccccggccggggagctcgcgtcgcttcctcccccctcagctcccctcgcaccctgagtcccccagccccactccgggaggggccgcgaaactgcacccgcaagggcctcatacatattttaaggagcaggccaggcaggtaaccggagctggactcggacggtgagggggcggcccccggggacctgataccctggatcccttacggctcagggctcaggcgggggaagaggtggctcaggacgacctggggtcctcactttgctggcctgtccagcgcatcctaagcccgcgtgtatcctaccccctccttctgcagatccaatgtccgtctggcaattgccccattccctctcgctggagagatcccttccgcctcgccacaggcgtcccacgctgcccggagtcgtgcgccccgggacgggtagttttgggttcctcgacgcttggccaggtttaggaaagacccgctgtcttccttgctgcccccacctaggagactcggcgccttgcgctccgtcctttttaatggtgtcgcggcttgtccctctggcttgctccctcctagtccctaccccacacggctcccttcgccagctccatgacaatcccactcgtgctgaagaccttgggcaaagaagtaaccatcggtcttcccctcccttcccattcctccggcggcaggactagggggaaaggtgcccgggatacaagcccctcacgcagacccactgatgcggccgtggttctgccattggcccctctccgaatggtgaggttctcctgctaaccctggccccatggcataactagtataaccccagtgagaggaacccagagttccagtcctcccctgctccagtccctctgtgatctcgatctcgagggattcacttcacctctctaagcctcagtttcccatttgcaaaatgggcagaatgactcgcacctctggggatgaagaaaatgcacatgtgagcacgtgggtacttggcgacccggagatctctgcaaactgcaggcccagcgagatggcctcagcacgccctgcaccctcgtccgcgcgactgccgccgggtgcccgccccagccgctgtgtccctggtgcttcctccgccagggccacgtgccggggaagccaaagcgggagtctttcgatcttggcccagcccttagccctcggtcctttgctctagcatctagattctcgtgggtcaacaaagtcactggaaacccaacgaacttcccgacatttttcgaaaaccgtatgcgtgtgcttctgtgcgtttttcctctgatcgaggtagggccctgtagggttctgtttggacgggaggctggagtggttccttcccggctgcggggtcggaggatgcagagattcgaaagaaggagaaacacagagactgtcaaatgaaaggagattctgtcttcggaatcgacccagctctttaaaagaatgaggaaaacatggggtctttatatatcctggaaagtcgcctaggcgttcag

SEQ ID NO: 128341 - DNA, 1399 bp, Homo sapiens; identical to SEQ ID NO: 96391
  misc_feature 1..1399: note = chr7:129424547-129425946
  misc_feature 1..1399: note = Hyper
  source 1..1399: mol_type = genomic DNA

SEQ ID NO: 128342 - DNA, 30 bp, Homo sapiens; identical to SEQ ID NO: 96392
  misc_feature 1..30: note = chr7:129426289-129426319
  misc_feature 1..30: note = Hyper
  source 1..30: mol_type = genomic DNA

SEQ ID NO: 128343 - DNA, 30 bp, Homo sapiens; identical to SEQ ID NO: 41454
  misc_feature 1..30: note = chr7:129782524-129782554
  misc_feature 1..30: note = Hypo
  source 1..30: mol_type = genomic DNA

SEQ ID NO: 128344 - DNA, 348 bp, Homo sapiens; identical to SEQ ID NO: 96394
  misc_feature 1..348: note = chr7:129794391-129794739
  misc_feature 1..348: note = Hypo
  source 1..348: mol_type = genomic DNA

SEQ ID NO: 128345 - DNA, 41 bp, Homo sapiens; identical to SEQ ID NO: 96395
  misc_feature 1..41: note = chr7:129800321-129800362
  misc_feature 1..41: note = Hypo
  source 1..41: mol_type = genomic DNA

SEQ ID NO: 128346 - DNA, 19 bp, Homo sapiens
  misc_feature 1..19: note = chr7:129844190-129844209
  misc_feature 1..19: note = Hypo
  source 1..19: mol_type = genomic DNA
ttatttgttttgagacgga

SEQ ID NO: 128347 - DNA, 30 bp, Homo sapiens; identical to SEQ ID NO: 41456
  misc_feature 1..30: note = chr7:129846079-129846109
  misc_feature 1..30: note = Hypo
  source 1..30: mol_type = genomic DNA

SEQ ID NO: 128348 - DNA, 30 bp, Homo sapiens; identical to SEQ ID NO: 96398
  misc_feature 1..30: note = chr7:129913242-129913272
  misc_feature 1..30: note = Hyper
  source 1..30: mol_type = genomic DNA

SEQ ID NO: 128349 - DNA, 31 bp, Homo sapiens; identical to SEQ ID NO: 96402
  misc_feature 1..31: note = chr7:131011381-131011412
  misc_feature 1..31: note = Hypo
  source 1..31: mol_type = genomic DNA

SEQ ID NO: 128350 - DNA, 81 bp, Homo sapiens; identical to SEQ ID NO: 96403
  misc_feature 1..81: note = chr7:131041515-131041596
  misc_feature 1..81: note = Hypo
  source 1..81: mol_type = genomic DNA

SEQ ID NO: 128351 - DNA, 147 bp, Homo sapiens; identical to SEQ ID NO: 96405
  misc_feature 1..147: note = chr7:131231034-131231181
  misc_feature 1..147: note = Hypo
  source 1..147: mol_type = genomic DNA

SEQ ID NO: 128352 - DNA, 42 bp, Homo sapiens; identical to SEQ ID NO: 96406
  misc_feature 1..42: note = chr7:131240674-131240716
  misc_feature 1..42: note = Hyper
  source 1..42: mol_type = genomic DNA

SEQ ID NO: 128353 - DNA, 379 bp, Homo sapiens; identical to SEQ ID NO: 96407
  misc_feature 1..379: note = chr7:131242722-131243101
  misc_feature 1..379: note = Hyper
  source 1..379: mol_type = genomic DNA

SEQ ID NO: 128354 - DNA, 65 bp, Homo sapiens; identical to SEQ ID NO: 96408
  misc_feature 1..65: note = chr7:131377139-131377204
  misc_feature 1..65: note = Hyper
  source 1..65: mol_type = genomic DNA

SEQ ID NO: 128355 - DNA, 30 bp, Homo sapiens; identical to SEQ ID NO: 96410
  misc_feature 1..30: note = chr7:131422856-131422886
  misc_feature 1..30: note = Hypo
  source 1..30: mol_type = genomic DNA

SEQ ID NO: 128356 - DNA, 271 bp, Homo sapiens; identical to SEQ ID NO: 96411
  misc_feature 1..271: note = chr7:131514720-131514991
  misc_feature 1..271: note = Hyper
  source 1..271: mol_type = genomic DNA

SEQ ID NO: 128357 - DNA, 30 bp, Homo sapiens; identical to SEQ ID NO: 96414
  misc_feature 1..30: note = chr7:132086857-132086887
  misc_feature 1..30: note = Hypo
  source 1..30: mol_type = genomic DNA

SEQ ID NO: 128358 - DNA, 187 bp, Homo sapiens; identical to SEQ ID NO: 96415
  misc_feature 1..187: note = chr7:132099502-132099689
  misc_feature 1..187: note = Hypo
  source 1..187: mol_type = genomic DNA

SEQ ID NO: 128359 - DNA, 37 bp, Homo sapiens; identical to SEQ ID NO: 96416
  misc_feature 1..37: note = chr7:132155928-132155965
  misc_feature 1..37: note = Hypo
  source 1..37: mol_type = genomic DNA

SEQ ID NO: 128360 - DNA, 37 bp, Homo sapiens; identical to SEQ ID NO: 96417
  misc_feature 1..37: note = chr7:132156085-132156122
  misc_feature 1..37: note = Hypo
  source 1..37: mol_type = genomic DNA

SEQ ID NO: 128361 - DNA, 2232 bp, Homo sapiens
  misc_feature 1..2232: note = chr7:132260210-132262442
  misc_feature 1..2232: note = Hyper
  source 1..2232: mol_type = genomic DNA
gaggactatatccctcgtgcttcccccttctagttctctttctcagacacacaccacgaaaggcatgtgacaggtgttcgccagccggaggcaccggggaaggcagccccatgtgcccagggagggtagggaggtgagaggggacccaagtcctgtgtctccaagtcctgtctgcttgctgctaagcaggcactgaggctgtgaataaggtcttaccttttaaggaggatctgacccccgtaccttccctagacaagcaacatacgcggcgatgctttaagccgctttctgcctgaaatctcggcgcattcccggggaagcagtgccacgcttcagaaaggcgtttgtgctgcctcttactggggaaacgcagtgtctgtttcatatgcgccgccctacagaactgcagccccaaccgcctatctggcctcctccccgggcgctgggccaccactctctccaaatatgcgtccgaatatctgtgggtctgtctcccgttgaaatcccagggtgtccaaaggccacggggccgcgatgacactgggtaggtctccggaaacctctcaggacttctcccattttaaagcccagctagggacgaaaggggctgggagctgaaaaattgctccctcaacctccccgggtgggaggcagagccgggaatacacagaatcccaccccgaaagtcccgggaaagagaagtctgagtccaggagcgtgagaggagaacacacccgggaaatccctgctccggccgctgcacctccgcgggcgtccaggtgggacgtgggcaggtgcgcgagcgccgtgtgtgccggtgtggatctgtgtgtgtgcctgcgtgtgtgcgtgtgcgtgtgccgcgggctggctccgggacactgaggactcccgggtcggcccaggtctgtccgaccttgctgccctcgccgcccgcccggccccactccccggcgggccggctccttacctggacgcgccgcgtttccctccttcagcgggagcgccgcattgacactgcagatggagcctatgccgctgcctctcgccctcctctgaacgtgtgcgtgtgcgcgcgtgtggctgcctcctccagccccagccccgaacgcaaatactccaccgaggcacagggaagccgggagcagccgaggaacgcggagggcgccgaatcagagcctgcggggcttgacagcttctcttgcggcgtccaaggtgggcgtaatgtccaacaaaaaggtcggaaaatggggatcgattccgaacacccctttcctccacccagccccggagcccgagcagcggcggcggctctcgggggctgcggtggcgacgccgggctgccccccttcgtccccacccccgcgggctgaatgtccttgatgccaagcgggcacagcggcgtcactccgcgccgcccatgctcgcccggtcgggccgctgcccgggcgcggcgagtgcgcgggggacccgccggggagcgctctcggcgcctctgcgcgcctctctgggtagcggcggccgccccccggcagcccgcggccggccgcgccgcggcagcccccacccttgccgagacactcgccgggcagtgccctggggccggggctggggggccgcgggagccgccggctgctccccggggaggcgcggggctgcggcggtggtggctgcggcggctggcgctgcggcggcggagagctcggccgcgggccgagccgggcctcccgggcgcgcccccggccccccgggcgggctgctcgcaaagtttgcagggggcagggagcggggccgccgctggctcggccgccgccggagctcccgggctgcctgctgccgccgcggctcgctgctgctgtgcattgaagcccggccaagcgctgcaaaaactccagctgcctggcgctctctgggtcctcctctcctccctcccgccctccctgcttcccttcctccctccctcgcctcgcctcctctcctccctgccgcccgccgcccgccgccgctccctctctggctcgctctcgctggctcggagctcgcggctgacatctagagcgagggagagcggccggcagagggggcagggggcgcctccctacatgctcccacccgccgccgcccggcttgccggctctcctccgcaccaacgtttgccgacacccccctgggtcccctcggcccgcacggagctaccctggcggtggcgatgtggggcggagagaggggcat

SEQ ID NO: 128362 - DNA, 236 bp, Homo sapiens; identical to SEQ ID NO: 96421
  misc_feature 1..236: note = chr7:132299552-132299788
  misc_feature 1..236: note = Hyper
  source 1..236: mol_type = genomic DNA

SEQ ID NO: 128363 - DNA, 332 bp, Homo sapiens; identical to SEQ ID NO: 96422
  misc_feature 1..332: note = chr7:132340002-132340334
  misc_feature 1..332: note = Hyper
  source 1..332: mol_type = genomic DNA

SEQ ID NO: 128364 - DNA, 117 bp, Homo sapiens; identical to SEQ ID NO: 41462
  misc_feature 1..117: note = chr7:132418949-132419066
  misc_feature 1..117: note = Hypo
  source 1..117: mol_type = genomic DNA

SEQ ID NO: 128365 - DNA, 470 bp, Homo sapiens
  misc_feature 1..470: note = chr7:133811925-133812395
  misc_feature 1..470: note = Hyper
  source 1..470: mol_type = genomic DNA
acaggaaagataagcgaacagaacagaccaaagagagaaaaataacagaagagactgagaaaaagaaaagtcaagtggagcgcccactgccccgcctgcagaaggcgagtacgcgcggaggagactacaggccccagaatcctccgcggttccccttgcctggggtcagtctcctaggcaaccccgctaaacaagatggcgacctccgagagggctctcctgaggaccagagctgcctctctcctgagaggcttgggcagatcccgaactggagcccgatcgttacagtttcgcgcagaaaaagagcgtcagccttgctggtcttttcccatggggcagaagacgaaaggcagctctaacatagcctcctcctacctgctccagcagctcatgcaccgctatcaggagctggactcggacggagatgaggaccagggcgagggcgaggcgggatccgaggagtcctcaga

SEQ ID NO: 128366 - DNA, 141 bp, Homo sapiens; identical to SEQ ID NO: 96432
  misc_feature 1..141: note = chr7:134116486-134116627
  misc_feature 1..141: note = Hypo
  source 1..141: mol_type = genomic DNA

SEQ ID NO: 128367 - DNA, 1167 bp, Homo sapiens
  misc_feature 1..1167: note = chr7:134142965-134144132
  misc_feature 1..1167: note = Hyper
  source 1..1167: mol_type = genomic DNA
attgtcattctcatccggctaggcacttctcggggacgctgtgtggtgttgaggttttacagggaaaatgctaaccttggcgcctcctgaattatcaactagctacggggtgcccagatttttctcccgagttccagacccagggcaccccgaggcggcgcctggccgaggagctccgcactgcgccttgttaacagctgggtccgggcaaactcgcgccacctaattctctgccctctaccggcttgagatgcttattcctcagggagggcaagaatcgaaacgattgagaccaactatttacaagtgaggcaaccgggctacaggtgcctcgagggaaaggaggctgggtctgcgctcccacaccttgccgacggctccacgtccctgtctgcgcccgaggtccaccggtctgtgaagcccactttccccgcctccctctcgcgttgtgccgcttggggcgcccgctaggacccaaaatgcggactggtgggccgcccatcaagggttgcccgcggtagggcgggggctcccgtgagctgctcccaaaccccactcgcaggatgctgccctgacgcccagggccaacccggggagccaaggcccccggtctctgcaaggccgaccccagcccgctggggaccctgcaagcccgcgcgtggctcccagcacgccgggcgtccgcggggcgagctgctcagggtcactcggggtccctcgccaatacaggccgcgcggagagtgtgaggcgagccccgggcccgcgcccccacgagcacctaccttccaggtacccaaccccaggatgggcatcttggcgccgttgttgagcaggagacggcttgccatggctgctgcgctccccagacccccgcccagtacggtgcggccttggccgcggcgcgtacctttaaatagcccgtgaggtcggcagaaagggcgcctgcggttggcgcgccgctgcgcgaaggagccttctgattggttgcgctgggggtgccgcggcggccttccccaagggtcggcggggatgcttcttccgcctggtcctagtggcagcggattctttccgcccccaacgctcgcccgcgccccgcgtggcagaaaggagttcctcagctgctgtatctggtgggaaagcgaatgctttagcgaaaataacaggca

SEQ ID NO: 128368 - DNA, 30 bp, Homo sapiens
  misc_feature 1..30: note = chr7:134833150-134833180
  misc_feature 1..30: note = Hyper
  source 1..30: mol_type = genomic DNA
tctgtgaccctccctcgctcatgtctgtat

SEQ ID NO: 128369 - DNA, 36 bp, Homo sapiens; identical to SEQ ID NO: 96438
  misc_feature 1..36: note = chr7:134864251-134864287
  misc_feature 1..36: note = Hypo
  source 1..36: mol_type = genomic DNA

SEQ ID NO: 128370 - DNA, 30 bp, Homo sapiens; identical to SEQ ID NO: 41464
  misc_feature 1..30: note = chr7:134880911-134880941
  misc_feature 1..30: note = Hypo
  source 1..30: mol_type = genomic DNA

SEQ ID NO: 128371 - DNA, 157 bp, Homo sapiens
  misc_feature 1..157: note = chr7:134885144-134885301
  misc_feature 1..157: note = Hypo
  source 1..157: mol_type = genomic DNA
gagagtgaaagatgccggcagaactgtgtactctctagacaatgacacttgcacacagagaagcttgcacccttctggaagcttcttctactgtgaccctaccttacacatctttgtaaccttagcacccagcaccacgcctcgcataagctgggca

SEQ ID NO: 128372 - DNA, 257 bp, Homo sapiens; identical to SEQ ID NO: 96441
  misc_feature 1..257: note = chr7:134918404-134918661
  misc_feature 1..257: note = Hypo
  source 1..257: mol_type = genomic DNA

SEQ ID NO: 128373 - DNA, 30 bp, Homo sapiens; identical to SEQ ID NO: 41467
  misc_feature 1..30: note = chr7:134953117-134953147
  misc_feature 1..30: note = Hypo
  source 1..30: mol_type = genomic DNA

SEQ ID NO: 128374 - DNA, 37 bp, Homo sapiens; identical to SEQ ID NO: 41468
  misc_feature 1..37: note = chr7:135125375-135125412
  misc_feature 1..37: note = Hypo
  source 1..37: mol_type = genomic DNA

SEQ ID NO: 128375 - DNA, 32 bp, Homo sapiens; identical to SEQ ID NO: 96445
  misc_feature 1..32: note = chr7:135196033-135196065
  misc_feature 1..32: note = Hypo
  source 1..32: mol_type = genomic DNA

SEQ ID NO: 128376 - DNA, 32 bp, Homo sapiens; identical to SEQ ID NO: 96446
  misc_feature 1..32: note = chr7:135196365-135196397
  misc_feature 1..32: note = Hypo
  source 1..32: mol_type = genomic DNA

SEQ ID NO: 128377 - DNA, 38 bp, Homo sapiens; identical to SEQ ID NO: 96447
  misc_feature 1..38: note = chr7:135234576-135234614
  misc_feature 1..38: note = Hypo
  source 1..38: mol_type = genomic DNA

SEQ ID NO: 128378 - DNA, 69 bp, Homo sapiens; identical to SEQ ID NO: 96448
  misc_feature 1..69: note = chr7:135391578-135391647
  misc_feature 1..69: note = Hypo
  source 1..69: mol_type = genomic DNA

SEQ ID NO: 128379 - DNA, 30 bp, Homo sapiens; identical to SEQ ID NO: 96449
  misc_feature 1..30: note = chr7:135393097-135393127
  misc_feature 1..30: note = Hypo
  source 1..30: mol_type = genomic DNA

SEQ ID NO: 128380 - DNA, 135 bp, Homo sapiens; identical to SEQ ID NO: 15032
  misc_feature 1..135: note = chr7:135401363-135401498
  misc_feature 1..135: note = Hypo
  source 1..135: mol_type = genomic DNA

SEQ ID NO: 128381 - DNA, 30 bp, Homo sapiens; identical to SEQ ID NO: 96451
  misc_feature 1..30: note = chr7:135412147-135412177
  misc_feature 1..30: note = Hypo
  source 1..30: mol_type = genomic DNA

SEQ ID NO: 128382 - DNA, 41 bp, Homo sapiens; identical to SEQ ID NO: 96452
  misc_feature 1..41: note = chr7:135854543-135854584
  misc_feature 1..41: note = Hypo
  source 1..41: mol_type = genomic DNA

SEQ ID NO: 128383 - DNA, 17 bp, Homo sapiens
  misc_feature 1..17: note = chr7:135863468-135863485
  misc_feature 1..17: note = Hypo
  source 1..17: mol_type = genomic DNA
tccgtctcaaaaaaaga

SEQ ID NO: 128384 - DNA, 105 bp, Homo sapiens; identical to SEQ ID NO: 96454
  misc_feature 1..105: note = chr7:135898002-135898107
  misc_feature 1..105: note = Hypo
  source 1..105: mol_type = genomic DNA

SEQ ID NO: 128385 - DNA, 23 bp, Homo sapiens
  misc_feature 1..23: note = chr7:135965324-135965347
  misc_feature 1..23: note = Hypo
  source 1..23: mol_type = genomic DNA
accatgcccggcatgactgctct

SEQ ID NO: 128386 - DNA, 136 bp, Homo sapiens; identical to SEQ ID NO: 96457
  misc_feature 1..136: note = chr7:136327342-136327478
  misc_feature 1..136: note = Hypo
  source 1..136: mol_type = genomic DNA

SEQ ID NO: 128387 - DNA, 90 bp, Homo sapiens; identical to SEQ ID NO: 96460
  misc_feature 1..90: note = chr7:136553405-136553495
  misc_feature 1..90: note = Hyper
  source 1..90: mol_type = genomic DNA

SEQ ID NO: 128388 - DNA, 2670 bp, Homo sapiens
  misc_feature 1..2670: note = chr7:136553555-136556225
  misc_feature 1..2670: note = Hyper
  source 1..2670: mol_type = genomic DNA
ttggccagagcctggaaatcgcagatttcaccaggaaatcgccgaggtacccgaataggtgttgcctcccaaaactaattcctacttccccaagcactttggtgaagaaatgaatccagcccagctcgccgaggcatccaggtctccattctattttggtctccaggctcttcgtgaaagccaggtttgaaagtcttgtttgcttctcctttagtggtttggcgtggagggcgggggcagcgtcaatttaactccagtctaaaccacgaacaggtcacagactagccaagtggctgagacgagtgtggggtgcgtgactctgcctgcgcgcgcgccagccccgcagctctcgccagagccttggggtcggttctctcccgcctctcccgcctctcccgccccacccctacagtgtctcggcatcaactaatcttttccttttcttttgcaagatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacaggtaagggccccgcgctgtgcagctctccgcttacccactccaagggccctggcaccagggggtctctcccttcatatccccccaagccggaggctcaggggtcggggcttgggggaattggagggaggtcctccccacgtgcagattctcaaacggaaactttggatcctggggcttggagggttgcgagcagtgatggcgggtctgaaaggaaggggcaaacgaggcacagcgcgaggcgaggtacccctacgattccgacggtcactgagtccagccgaatgtggcgaaagcagcctgggagctgcgctgtcccggcgtcgctccctattccagccccccattccctctactgttgctgacccccctcccgccacccactccagatgcagccatggacaagacaaggagagcttcgtccctcccgcccctcgggttccttcctgctggggtctgaccgcgtcttctgtgcgtgtgggatggaggcccggctcgctcgggctccgagctgtcccccggctccgctttcggagcagcccttgggcgctggagaggtttcccattgcggtctccaggtcatggccaaggaggagaagcaattagaatgggggaaagggtcccaagacaaaggagagggaagcattctgcaatcccatcctatttgagccccgcgcaggagctggactgtccgccgtggctgggggacaaggtctcagcccgaagctcatgaggtaccagacagtgcctgggcttcgccacctaactcacaatgggtcctgaaccgcccgggcagtccccggggtcgtagactggggaccgctgcacccctccccgcccgcaatgtcccttggagtccgcacctgaggtcccaggcaatcgccgctaacttgtagctctcggacacggacaggtgcggtccatgcctggtgccggtagacgcgcagaaattccacctgtgcgcgctgcccggcgcccctggggcccctcacggggtaagtagagactcatctgggagaggtgaaaattccccagaattattgacacacacggcggcacaccctttgcctccgtccgcctccagcatccgcatccctttctctatcttcctgcccattgccgtcctcgaggctgccctgagatacagaattgtcccaggctgagtccaccgacccgccagtccctggcgatgatgccaaggctcttgcatgtacggaaataccagcagggaggttcgccaggggcagagaggctggaggagaacagagaattggaggtaaacgcgtaaagccagcagaactgtcggtggacatttcacccaggccgccctcccgcgtctttaagtcagttcaccgccacagcacgtctgtgactgcggccacccagggctccaagtctgccagcccaggcgccgcgagccaagaagagcgcggcgcctcccactcctcaagctccggaatcccccacatcgactttctatttccctgtcttcttttcttttttgtttgttttgcttttcctgctcttttcttagcgctgggtggcagtgggtatgcggcagccgtgtgatttgcccatcccctagtacacgcagccagcgacacaagcacacagcgaccagtccccacgctgtgccacacaccctccagcggtccggcgcgcagcccctgctccacagcccgggacgcctgcagccaccgccagggtcatggccatggcccacgcagggctctgcgggtggagaggggaagtcagcctagactccagagagaaaccctggggcaacccgaaaggcctgaggaaaactggaattggggttaggcatgaggggagggagtctctggggaaaacgggccgggctgtgcggagccctgagggctcctgcggctgcagcgctgcaggccgcccgcgtctcgccccgccccgccgctgggcgtccccgccaggagcccacccgcgggcggcagcttttctccatgctgcccagggaagttcgatgcctggtgctgggatgcgccagcgcttctgttcgcttctggcaatcctggcgtctcccaatgaga

SEQ ID NO: 128389 - DNA, 30 bp, Homo sapiens; identical to SEQ ID NO: 96466
  misc_feature 1..30: note = chr7:136849171-136849201
  misc_feature 1..30: note = Hypo
  source 1..30: mol_type = genomic DNA

SEQ ID NO: 128390 - DNA, 79 bp, Homo sapiens; identical to SEQ ID NO: 96469
  misc_feature 1..79: note = chr7:137028481-137028560
  misc_feature 1..79: note = Hyper
  source 1..79: mol_type = genomic DNA

SEQ ID NO: 128391 - DNA, 36 bp, Homo sapiens; identical to SEQ ID NO: 41476
  misc_feature 1..36: note = chr7:137092635-137092671
  misc_feature 1..36: note = Hypo
  source 1..36: mol_type = genomic DNA

SEQ ID NO: 128392 - DNA, 17 bp, Homo sapiens
  misc_feature 1..17: note = chr7:137273241-137273258
  misc_feature 1..17: note = Hypo
  source 1..17: mol_type = genomic DNA
agatggagtctcaatcg

SEQ ID NO: 128393 - DNA, 38 bp, Homo sapiens; identical to SEQ ID NO: 96472
  misc_feature 1..38: note = chr7:137285723-137285761
  misc_feature 1..38: note = Hypo
  source 1..38: mol_type = genomic DNA

SEQ ID NO: 128394 - DNA, 1199 bp, Homo sapiens
  misc_feature 1..1199: note = chr7:137531242-137532441
  misc_feature 1..1199: note = Hyper
  source 1..1199: mol_type = genomic DNA
cagcttctcctccagcgcttcgtccttctccttctggccggcggccgcgggctcgtccagggcagcggcccccgccgccgcggctgaccctgcgccccgcgggtccgcgccgccctcggcgcccaggcagcagctcccggcgccgcttccgctgctgctgctgccgcccgtcgcccctttctcctctcccgccgaggagctggggttcatggcgcccgctccggcggccgcggagggagcgcaggcggcgccgctgcaggggccgggcgggctggcggcggcggcggcggcggctgcaggagcgcgggcaggtccgcgcgccgctggcaggggcagcaaatggcagccccttcccgcagcatccatccgcggctgcaccgcaccggggcattgtgggaaactccgctcactcccccgccccggccaatcagaggccgccgctccccgcctcccgcgccctcccgcgccggcccgcaccctccagccccgccggcctcttcctaaatcccgagcgaaagcccaagctgaacatgaactctgcccggaggcgacgggctgcggcggagggggagagagaggaggacaggctgcgaccccgggctggggacgccagggcagggacagcgagcatcaggaaggagagcgtccggggaactcgagtggccgcgccctgggtcctgcaccgtgaggctggggggaccaggaccggcgggcgcccaccttggtcctgagcccagctgccgacgctgggccagcaccctctccaccgccgccctccagtgagcagagctgggctcaggcagcagcccctgggcgcgggaaggtagcgggagctgcatttaggggaggggggaggtagcaggagctccgccagtgggaaccttggagtgaattcgtcggcgggtgccaagtcgaagcgccgacctcctgtctctggactggggcccggacccctgcgtccccaaactgcgtccccgccttgctcgtcgcccggtgccttccttaggcgcagcagaccctcggtaaacagcggttaattcgatggaatcggatcacagggccctcggtgaagcagaaaggcggaggaaatccaggaggcagaagtgaggaccctggcgcctggcgccgctgcgttgttcgtataagaagaggcatcccggaaggggcttcaaaccacttaggaccgactgctgaaacga

SEQ ID NO: 128395 - DNA, 206 bp, Homo sapiens; identical to SEQ ID NO: 96476
  misc_feature 1..206: note = chr7:137637131-137637337
  misc_feature 1..206: note = Hypo
  source 1..206: mol_type = genomic DNA

SEQ ID NO: 128396 - DNA, 87 bp, Homo sapiens; identical to SEQ ID NO: 96477
  misc_feature 1..87: note = chr7:137664095-137664182
  misc_feature 1..87: note = Hypo
  source 1..87: mol_type = genomic DNA

SEQ ID NO: 128397 - DNA, 18 bp, Homo sapiens
  misc_feature 1..18: note = chr7:137693378-137693396
  misc_feature 1..18: note = Hypo
  source 1..18: mol_type = genomic DNA
acacggcctcggtgtgtt

SEQ ID NO: 128398 - DNA, 140 bp, Homo sapiens; identical to SEQ ID NO: 96479
  misc_feature 1..140: note = chr7:138042204-138042344
  misc_feature 1..140: note = Hypo
  source 1..140: mol_type = genomic DNA

SEQ ID NO: 128399 - DNA, 30 bp, Homo sapiens; identical to SEQ ID NO: 96481
  misc_feature 1..30: note = chr7:138574167-138574197
  misc_feature 1..30: note = Hypo
  source 1..30: mol_type = genomic DNA

SEQ ID NO: 128400 - DNA, 38 bp, Homo sapiens; identical to SEQ ID NO: 96482
  misc_feature 1..38: note = chr7:138794899-138794937
  misc_feature 1..38: note = Hyper
  source 1..38: mol_type = genomic DNA

SEQ ID NO: 128401 - DNA, 15 bp, Homo sapiens
  misc_feature 1..15: note = chr7:138845476-138845491
  misc_feature 1..15: note = Hypo
  source 1..15: mol_type = genomic DNA
cggcccaagtcactt

SEQ ID NO: 128402 - DNA, 74 bp, Homo sapiens; identical to SEQ ID NO: 96484
  misc_feature 1..74: note = chr7:138912533-138912607
  misc_feature 1..74: note = Hypo
  source 1..74: mol_type = genomic DNA

SEQ ID NO: 128403 - DNA, 157 bp, Homo sapiens; identical to SEQ ID NO: 96485
  misc_feature 1..157: note = chr7:138913166-138913323
  misc_feature 1..157: note = Hypo
  source 1..157: mol_type = genomic DNA

SEQ ID NO: 128404 - DNA, 82 bp, Homo sapiens; identical to SEQ ID NO: 96486
  misc_feature 1..82: note = chr7:138957148-138957230
  misc_feature 1..82: note = Hypo
  source 1..82: mol_type = genomic DNA

SEQ ID NO: 128405 - DNA, 82 bp, Homo sapiens; identical to SEQ ID NO: 96487
  misc_feature 1..82: note = chr7:139027220-139027302
  misc_feature 1..82: note = Hypo
  source 1..82: mol_type = genomic DNA

SEQ ID NO: 128406 - DNA, 30 bp, Homo sapiens; identical to SEQ ID NO: 96488
  misc_feature 1..30: note = chr7:139106981-139107011
  misc_feature 1..30: note = Hypo
  source 1..30: mol_type = genomic DNA

SEQ ID NO: 128407 - DNA, 30 bp, Homo sapiens; identical to SEQ ID NO: 41485
  misc_feature 1..30: note = chr7:139112625-139112655
  misc_feature 1..30: note = Hypo
  source 1..30: mol_type = genomic DNA

SEQ ID NO: 128408 - DNA, 86 bp, Homo sapiens; identical to SEQ ID NO: 96490
  misc_feature 1..86: note = chr7:139115423-139115509
  misc_feature 1..86: note = Hypo
  source 1..86: mol_type = genomic DNA

SEQ ID NO: 128409 - DNA, 30 bp, Homo sapiens; identical to SEQ ID NO: 96491
  misc_feature 1..30: note = chr7:139123790-139123820
  misc_feature 1..30: note = Hypo
  source 1..30: mol_type = genomic DNA

SEQ ID NO: 128410 - DNA, 1194 bp, Homo sapiens
  misc_feature 1..1194: note = chr7:139167531-139168725
  misc_feature 1..1194: note = Hyper
  source 1..1194: mol_type = genomic DNA
cggtcagctgcccagcggtccagggctgggcgggtgtgggggtttcggctacgtccacccgacctggcggcgtcggctgccggcgcaggtgagcactcacccgtaagcgttacggcccggggcagcttctcgtcgccgtccaaccccgcgcggggcaacagcgccgcatcctccttctccagccccagctccttgcagcggcagcacgtgggggagcccggggagccggcgcttccttccgcggggctggcccggccctctgcgtcgcagccgctctccgtccgggctgcagccagcggcgagcggcggccccacgtgccgccctgggatggtgcgcgcagcaggagctggtgcgccgggtccgcgtggcgggagaaggcaggggactcgggcaccggcaccttgaggaagcgcgtggagggcctgggcgatggcgtgctgctgccaccggccgcgcccacgggcttcacgcgcacatctacctgcagctccatgggcgcccaggcgctgggcgcaggctcagccccgggcgcctcgccattccggggcagcttgaccaaggcagggcccggtgacggcggctcggggcagaccccgtagcccaggctgagcggcggcacgcgcggggacccggggcgaggcgaaggcggctttttcttgctcgagggctccaggcctgcgcccgccgccttctccacggccccggccggacttgggctgctttcgggaccttcaggttgtcgcaccttcgcgggcacctgcggctgctccagcgtggggaccaggcttcccacgggctccattgggagctctgccccggcttggcctccgggcgcagcctcccaagactcctccatcccgcgcgccccgccacccggagacgctgaggagcgcacctgggcccagtgcagaggagcttcgctctcctccgtccggattggtccagccgcgtcgccgaagttgtcaggccacgcccctccccgaaggaccccgctgtgattggctgtggctgaggttctgctgccccgacccccttcgggacacagccccggcctccaccaggcactgggagggagctgagaacggcagcggggccaggcgagggttgcagggtgggcgggagctctcgggagaaaagcagaacaccagcggaggcttgtggcagggaacccggagccccgcctgacccttccc

SEQ ID NO: 128411 - DNA, 38 bp, Homo sapiens; identical to SEQ ID NO: 96495
  misc_feature 1..38: note = chr7:139207995-139208033
  misc_feature 1..38: note = Hyper
  source 1..38: mol_type = genomic DNA

SEQ ID NO: 128412 - DNA, 565 bp, Homo sapiens
  misc_feature 1..565: note = chr7:139208245-139208810
  misc_feature 1..565: note = Hyper
  source 1..565: mol_type = genomic DNA
tagaaccaggtctcccggctccaagactgcgctcccagctcgacagcatccagcctccagcccaggtggcggggtcggggagccggctgtccccgctcctccgcgcctcctccctctccgcccctgccccgccccgcccgggtccacggctcccggctcccgcgcgccgcctcgcgctcctccccagcccggctgtgcgtggaggctgcggctcggcggggcaggcgctgagcgcaccgcggcggcacccggcgcagaggctccagcgcggggagccgggctcagccccggcctgccagcgccgcggtcctagcccacccgaggccggcctggggggcccgcagggcgcgcggagcgccgagtgcgcgtcgggctgggccccgcaccccggtgcaggagcgcgggcgcggcgcggcggagcgccccgcatggagccggcccgggagcccccctcgcgggcccggccgccgccgcccctcgccgcgcgccccgcgcccgcccccgccgcccccaggccgcgttcgcccgcagaggctgaggcccgcggccccgaggggctgctgcg

SEQ ID NO: 128413 - DNA, 30 bp, Homo sapiens; identical to SEQ ID NO: 41486
  misc_feature 1..30: note = chr7:139245499-139245529
  misc_feature 1..30: note = Hypo
  source 1..30: mol_type = genomic DNA

SEQ ID NO: 128414 - DNA, 30 bp, Homo sapiens; identical to SEQ ID NO: 96499
  misc_feature 1..30: note = chr7:139546165-139546195
  misc_feature 1..30: note = Hypo
  source 1..30: mol_type = genomic DNA

SEQ ID NO: 128415 - DNA, 159 bp, Homo sapiens; identical to SEQ ID NO: 96501
  misc_feature 1..159: note = chr7:139650627-139650786
  misc_feature 1..159: note = Hypo
  source 1..159: mol_type = genomic DNA

SEQ ID NO: 128416 - DNA, 30 bp, Homo sapiens; identical to SEQ ID NO: 96502
  misc_feature 1..30: note = chr7:139779255-139779285
  misc_feature 1..30: note = Hypo
  source 1..30: mol_type = genomic DNA

SEQ ID NO: 128417 - DNA, 96 bp, Homo sapiens; identical to SEQ ID NO: 96504
  misc_feature 1..96: note = chr7:139842977-139843073
  misc_feature 1..96: note = Hypo
  source 1..96: mol_type = genomic DNA

SEQ ID NO: 128418 - DNA, 30 bp, Homo sapiens; identical to SEQ ID NO: 41488
  misc_feature 1..30: note = chr7:139919897-139919927
  misc_feature 1..30: note = Hypo
  source 1..30: mol_type = genomic DNA

SEQ ID NO: 128419 - DNA, 195 bp, Homo sapiens; identical to SEQ ID NO: 96506
  misc_feature 1..195: note = chr7:139930151-139930346
  misc_feature 1..195: note = Hyper
  source 1..195: mol_type = genomic DNA

SEQ ID NO: 128420 - DNA, 213 bp, Homo sapiens; identical to SEQ ID NO: 96507
  misc_feature 1..213: note = chr7:139938997-139939210
  misc_feature 1..213: note = Hypo
  source 1..213: mol_type = genomic DNA

SEQ ID NO: 128421 - DNA, 68 bp, Homo sapiens; identical to SEQ ID NO: 41490
  misc_feature 1..68: note = chr7:140007275-140007343
  misc_feature 1..68: note = Hypo
  source 1..68: mol_type = genomic DNA

SEQ ID NO: 128422 - DNA, 232 bp, Homo sapiens; identical to SEQ ID NO: 96509
  misc_feature 1..232: note = chr7:140015548-140015780
  misc_feature 1..232: note = Hypo
  source 1..232: mol_type = genomic DNA

SEQ ID NO: 128423 - DNA, 21 bp, Homo sapiens
  misc_feature 1..21: note = chr7:140026923-140026944
  misc_feature 1..21: note = Hypo
  source 1..21: mol_type = genomic DNA
acggagcgagattctgtctca

SEQ ID NO: 128424 - DNA, 31 bp, Homo sapiens; identical to SEQ ID NO: 41492
  misc_feature 1..31: note = chr7:140096707-140096738
  misc_feature 1..31: note = Hypo
  source 1..31: mol_type = genomic DNA

SEQ ID NO: 128425 - DNA, 30 bp, Homo sapiens; identical to SEQ ID NO: 41493
  misc_feature 1..30: note = chr7:140097278-140097308
  misc_feature 1..30: note = Hypo
  source 1..30: mol_type = genomic DNA

SEQ ID NO: 128426 - DNA, 154 bp, Homo sapiens; identical to SEQ ID NO: 96513
  misc_feature 1..154: note = chr7:140156524-140156678
  misc_feature 1..154: note = Hypo
  source 1..154: mol_type = genomic DNA

SEQ ID NO: 128427 - DNA, 19 bp, Homo sapiens
  misc_feature 1..19: note = chr7:140176253-140176272
  misc_feature 1..19: note = Hypo
  source 1..19: mol_type = genomic DNA
agagcgacactccatctca

SEQ ID NO: 128428 - DNA, 120 bp, Homo sapiens; identical to SEQ ID NO: 96515
  misc_feature 1..120: note = chr7:140180178-140180298
  misc_feature 1..120: note = Hypo
  source 1..120: mol_type = genomic DNA

SEQ ID NO: 128429 - DNA, 76 bp, Homo sapiens; identical to SEQ ID NO: 96516
  misc_feature 1..76: note = chr7:140192162-140192238
  misc_feature 1..76: note = Hypo
  source 1..76: mol_type = genomic DNA

SEQ ID NO: 128430 - DNA, 153 bp, Homo sapiens; identical to SEQ ID NO: 96517
  misc_feature 1..153: note = chr7:140227048-140227201
  misc_feature 1..153: note = Hypo
  source 1..153: mol_type = genomic DNA

SEQ ID NO: 128431 - DNA, 36 bp, Homo sapiens; identical to SEQ ID NO: 96518
  misc_feature 1..36: note = chr7:140268315-140268351
  misc_feature 1..36: note = Hypo
  source 1..36: mol_type = genomic DNA

SEQ ID NO: 128432 - DNA, 80 bp, Homo sapiens
  misc_feature 1..80: note = chr7:140339825-140339905
  misc_feature 1..80: note = Hyper
  source 1..80: mol_type = genomic DNA
actgcaaatgctgaccgctgtgaggggggcccggctgctcagccgcctcgatgccccgcgcttgcacgcgcacgcacaca

SEQ ID NO: 128433 - DNA, 260 bp, Homo sapiens; identical to SEQ ID NO: 96523
  misc_feature 1..260: note = chr7:140339965-140340225
  misc_feature 1..260: note = Hyper
  source 1..260: mol_type = genomic DNA

SEQ ID NO: 128434 - DNA, 454 bp, Homo sapiens; identical to SEQ ID NO: 96524
  misc_feature 1..454: note = chr7:140340551-140341005
  misc_feature 1..454: note = Hyper
  source 1..454: mol_type = genomic DNA

SEQ ID NO: 128435 - DNA, 23 bp, Homo sapiens
  misc_feature 1..23: note = chr7:140732424-140732447
  misc_feature 1..23: note = Hypo
  source 1..23: mol_type = genomic DNA
gaataggaagagctccggtctac

SEQ ID NO: 128436 - DNA, 226 bp, Homo sapiens; identical to SEQ ID NO: 96526
  misc_feature 1..226: note = chr7:140771324-140771550
  misc_feature 1..226: note = Hyper
  source 1..226: mol_type = genomic DNA

SEQ ID NO: 128437 - DNA, 72 bp, Homo sapiens; identical to SEQ ID NO: 31590
  misc_feature 1..72: note = chr7:140771769-140771841
  misc_feature 1..72: note = Hyper
  source 1..72: mol_type = genomic DNA

SEQ ID NO: 128438 - DNA, 2138 bp, Homo sapiens
  misc_feature 1..2138: note = chr7:140772281-140774419
  misc_feature 1..2138: note = Hyper
  source 1..2138: mol_type = genomic DNA
aagacttagacatttcgtgcctgggaaatggtgcagtttatctttaaggagactagaaaaataagagatgaggctcacgttgcacggatgacatcactagcttttggctgcgcgctcggtgttctcgtctgtgggttttagccaaggctgcagctacccgcgccggacgagagagcgcggcagcagcttcctccggcgcccgcacccgggcaatgcgatttccccagtcccctgggcgcagcctgggctctcgcgcctcccgggcaccagccgagcctgcgaggcctcggagccgccgcggctagaggaggaggcgacgaggggaagccgagtgacccagcctccctcccccaccctctccccattcatctcggcgaccaccgcgcgccgggagccggatcgtgggacgccgaggccaggacgggattctctgcacgctgtcgagtgagccggcatctcggcgcccgggtgggctgcgaagaaaatggtgcaatctgagagcgactgagcccagctgggcagagcagacggggtgccagagtgccaagggctcaggtgcctggagaaaggggcggattgtttggaggggccgggaccggggttttcttcggtgcctgcggcattttctttgcacctgggcggcaggctcccggggctcccgggtgccagatgaagtgaggcggaggcgtcgcgggagagccgggtccggaggcggtcgggtggacactccaggcagaagacggcgctgggaagagctgcgtgacgctcgggggctggcggctgggccggcagcgcgccgtggcggcgtgacctgtccatggtgttgaaggcgcggtgggccgagcccctagcgccgcgcgcagtgagcgctgcctggtgcaccctccgccgcgcagcccgcccctcgcgtccgccagcagccgcccagtctccgcagatcccaggccgggtctcgtccggtaacgccgcccgggtgaacacgctgtcggcccgaggggccgcctgaatggcgatgccagaggcagggcaccggggagctcgcggggaaaggtcggccgagagcgtgcgtccgcggggagtgcgcctctgagcgcagcacgcgggtcagaaggagcaaccgacctgctggtgaccagagaacggagattttaagaggacccgacccaaagaggaagaacatttctgggtgcgcgccccaggtctttgcttgcagacggggagggggagaggctctgagccagagacccaggagggactccgagaagccggccccagcacctggaggtttctttcgcccgccggccgcatccggggcgttctacttcacccggtggtccagtggcgcctcctgacagcaccccccgtccccctcagagagacaggcgagttctgtcccgtcaccatcctgcacaaagaagccccaccgcagccgaggacacttggcatttagtttccggcccgagggcagcggcgcccgaagccgggctgggagccgaggcggctgcttcggggcagtcgcttcctgcggggcggggagggggcgggaggcggccgcgctgggttcgccgccgccggaggctgcacctgcctcagaggatgcccaggagcccgcgggagcctctccggatcagaactttttaggccgcccgcccccatccccgcagtccccgggccgtgctccggtaggcgggggccgagggggcgccgcggcgcgagtccctctcctgccccctcccccagctcggccgcccgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggcagtacaactcc

SEQ ID NO: 128439 - DNA, 36 bp, Homo sapiens; identical to SEQ ID NO: 96532
  misc_feature 1..36: note = chr7:140992705-140992741
  misc_feature 1..36: note = Hypo
  source 1..36: mol_type = genomic DNA

SEQ ID NO: 128440 - DNA, 187 bp, Homo sapiens; identical to SEQ ID NO: 96533
  misc_feature 1..187: note = chr7:141007214-141007401
  misc_feature 1..187: note = Hypo
  source 1..187: mol_type = genomic DNA

SEQ ID NO: 128441 - DNA, 30 bp, Homo sapiens; identical to SEQ ID NO: 96534
  misc_feature 1..30: note = chr7:141137501-141137531
  misc_feature 1..30: note = Hypo
  source 1..30: mol_type = genomic DNA

SEQ ID NO: 128442 - DNA, 236 bp, Homo sapiens; identical to SEQ ID NO: 96535
  misc_feature 1..236: note = chr7:141211363-141211599
  misc_feature 1..236: note = Hyper
  source 1..236: mol_type = genomic DNA

SEQ ID NO: 128443 - DNA, 29 bp, Homo sapiens
  misc_feature 1..29: note = chr7:141534669-141534698
  misc_feature 1..29: note = Hypo
  source 1..29: mol_type = genomic DNA
caggcgtaagccaccgtgcccggcctcgt

SEQ ID NO: 128444 - DNA, 24 bp, Homo sapiens
  misc_feature 1..24: note = chr7:141557650-141557674
  misc_feature 1..24: note = Hypo
  source 1..24: mol_type = genomic DNA
gtgagccaccgtgcccagctgcta

SEQ ID NO: 128445 - DNA, 306 bp, Homo sapiens; identical to SEQ ID NO: 96540
  misc_feature 1..306: note = chr7:143042619-143042925
  misc_feature 1..306: note = Hyper
  source 1..306: mol_type = genomic DNA

SEQ ID NO: 128446 - DNA, 84 bp, Homo sapiens; identical to SEQ ID NO: 96541
  misc_feature 1..84: note = chr7:143060085-143060169
  misc_feature 1..84: note = Hyper
  source 1..84: mol_type = genomic DNA

SEQ ID NO: 128447 - DNA, 472 bp, Homo sapiens
  misc_feature 1..472: note = chr7:143579623-143580095
  misc_feature 1..472: note = Hyper
  source 1..472: mol_type = genomic DNA
tcaccagcagaaatacggacacaaaggggattctctgtccccgatgatttctgatttcggcacacccagacccacggcgcacccatcgcgccccgcacccccgccccggcctcccgccctgccctcccccccgcagcacccaggccgagtccaccgttgctggccccttctccagcctgccaggcttttggagagggccactcaccaggtcaccctgcgatttccacgggggcaggtgggagcgggcagagcctggcgcagagaggaatgcacagggaagaggcttccctgtaccagtgactgggcgaccgagccgggatttgggagcggggaggaggctggagctggaggagaggaggggtttccacgggagtcccctcctccccacttcctcccaggctggagtgggagctccagggggcggcgcttggcgggggacagcgcttctttgtgtcgccggccctggtggctt

SEQ ID NO: 128448 - DNA, 30 bp, Homo sapiens; identical to SEQ ID NO: 96545
  misc_feature 1..30: note = chr7:143737774-143737804
  misc_feature 1..30: note = Hypo
  source 1..30: mol_type = genomic DNA

SEQ ID NO: 128449 - DNA, 30 bp, Homo sapiens; identical to SEQ ID NO: 96546
  misc_feature 1..30: note = chr7:144185679-144185709
  misc_feature 1..30: note = Hypo
  source 1..30: mol_type = genomic DNA

SEQ ID NO: 128450 - DNA, 30 bp, Homo sapiens; identical to SEQ ID NO: 41496
  misc_feature 1..30: note = chr7:144488206-144488236
  misc_feature 1..30: note = Hypo
  source 1..30: mol_type = genomic DNA

SEQ ID NO: 128451 - DNA, 30 bp, Homo sapiens; identical to SEQ ID NO: 96550
  misc_feature 1..30: note = chr7:144565945-144565975
  misc_feature 1..30: note = Hypo
  source 1..30: mol_type = genomic DNA

SEQ ID NO: 128452 - DNA, 1497 bp, Homo sapiens
  misc_feature 1..1497: note = chr7:145812702-145814199
  misc_feature 1..1497: note = Hyper
  source 1..1497: mol_type = genomic DNA
gcatatgtatgagtacgaattaattacatatcgaaaacatgtgcattaacggcatctgcagtcctccctccctgctccagtcagtcgggatgtttagcaccgtcacttggtgttaggaccactcggaagacctgcctgtcggacgcctgactgtggttcccggggggccggagctccaggagcctgtaccatctttatctgaaggggaggagagaaggaaaggagaaggcatccgagcgagggtgttctccttcctgcagccgggtagggggcagccaggtttggagcagggttctaggattacacggcaaatccccaacttcagcaccgcggacagcatcacctcccgcccagggagaggcgcgcgcctccttgctccgcccccgccccagctgatggaccccggccggtcggctcagtctcccttttgctttcaaacgaggccagggcagggcagaagggttttgacagccagaggggtacggtaaggaggaggaagaggaggaggaggcggaggaggaggaggagccgaggagggaaccgagaagggaagagaagggagggcttccctccgcctcgctcgccgcccgggctcacaggagctggcggcggcggcggcggcggcggcgtctcctgctctccgcggctgttgctgctgctcgcgctccgccgcccgggagatgcttcctcgcgcggcgcagcgctgaggccgtgcgtgcgccccggctgcgctgcgcgctccccacatacacaagctctccatgtgagctgacaggcgagtggaaacccctcgagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctcttccccctcctttgccttcttggtttgaatttcctcccccggcgttgcactggcacacagtgcaagaggcaatacccgcacggagggagaacgaaggctgagactcccctgccgctccaagcccggaagaactggagcctggaggggggtgaggggagaagaggaagcgggaggggcttggcttcctcgcgtatttgaggacagcccatctcccttcaagaaccctacggagagtcggactgcatctccgcagcgagctcttggagcgccgccggccgggaggcgaaggatgcaggcggctccgcgcgccggctgcggggcagcgctcctgctgtggattgtcagcagctgcctctgcagagcctggacggctccctccacgtcccgtaagtagccgtctcctcgctctgctctggagcagtttcagtgcggcattgatgtttggcaccagggtatcaactccgaagtgcatcgcagtgctggcaccctgatgtgtttgtgtctccgctgtcacacactt

SEQ ID NO: 128453 - DNA, 22 bp, Homo sapiens
  misc_feature 1..22: note = chr7:146300226-146300248
  misc_feature 1..22: note = Hypo
  source 1..22: mol_type = genomic DNA
gggcgaggtggctcacgcctgt

SEQ ID NO: 128454 - DNA, 23 bp, Homo sapiens
  misc_feature 1..23: note = chr7:146757526-146757549
  misc_feature 1..23: note = Hypo
  source 1..23: mol_type = genomic DNA
tgtgcaggctgggcacgatggct

SEQ ID NO: 128455 - DNA, 18 bp, Homo sapiens
  misc_feature 1..18: note = chr7:146758938-146758956
  misc_feature 1..18: note = Hypo
  source 1..18: mol_type = genomic DNA
ttctttggccgggcacgg

SEQ ID NO: 128456 - DNA, 18 bp, Homo sapiens
  misc_feature 1..18: note = chr7:147750129-147750147
  misc_feature 1..18: note = Hypo
  source 1..18: mol_type = genomic DNA
ctccgtctcaaaaaaaca

SEQ ID NO: 128457 - DNA, 19 bp, Homo sapiens
  misc_feature 1..19: note = chr7:147816617-147816636
  misc_feature 1..19: note = Hypo
  source 1..19: mol_type = genomic DNA
actccgtctcagaaaaaaa

SEQ ID NO: 128458 - DNA, 58 bp, Homo sapiens; identical to SEQ ID NO: 96565
  misc_feature 1..58: note = chr7:147939618-147939676
  misc_feature 1..58: note = Hyper
  source 1..58: mol_type = genomic DNA

SEQ ID NO: 128459 - DNA, 27 bp, Homo sapiens
  misc_feature 1..27: note = chr7:147991189-147991216
  misc_feature 1..27: note = Hypo
  source 1..27: mol_type = genomic DNA
ggaaaaagcaggcggtgtttcctattc

SEQ ID NO: 128460 - DNA, 95 bp, Homo sapiens; identical to SEQ ID NO: 96567
  misc_feature 1..95: note = chr7:148224591-148224686
  misc_feature 1..95: note = Hypo
  source 1..95: mol_type = genomic DNA

SEQ ID NO: 128461 - DNA, 30 bp, Homo sapiens; identical to SEQ ID NO: 41499
  misc_feature 1..30: note = chr7:148500594-148500624
  misc_feature 1..30: note = Hypo
  source 1..30: mol_type = genomic DNA

SEQ ID NO: 128462 - DNA, 20 bp, Homo sapiens
  misc_feature 1..20: note = chr7:148582580-148582600
  misc_feature 1..20: note = Hypo
  source 1..20: mol_type = genomic DNA
aggatatttgcaaggcgcgg

SEQ ID NO: 128463 - DNA, 95 bp, Homo sapiens; identical to SEQ ID NO: 5071
  misc_feature 1..95: note = chr7:148640241-148640336
  misc_feature 1..95: note = Hypo
  source 1..95: mol_type = genomic DNA

SEQ ID NO: 128464 - DNA, 24 bp, Homo sapiens
  misc_feature 1..24: note = chr7:148819014-148819038
  misc_feature 1..24: note = Hypo
  source 1..24: mol_type = genomic DNA
tgtttttttttgagacggagtctc

SEQ ID NO: 128465 - DNA, 213 bp, Homo sapiens; identical to SEQ ID NO: 96572
  misc_feature 1..213: note = chr7:148841978-148842191
  misc_feature 1..213: note = Hypo
  source 1..213: mol_type = genomic DNA

SEQ ID NO: 128466 - DNA, 149 bp, Homo sapiens; identical to SEQ ID NO: 41502
  misc_feature 1..149: note = chr7:148846075-148846224
  misc_feature 1..149: note = Hypo
  source 1..149: mol_type = genomic DNA

SEQ ID NO: 128467 - DNA, 40 bp, Homo sapiens; identical to SEQ ID NO: 96574
  misc_feature 1..40: note = chr7:148883977-148884017
  misc_feature 1..40: note = Hypo
  source 1..40: mol_type = genomic DNA

SEQ ID NO: 128468 - DNA, 37 bp, Homo sapiens; identical to SEQ ID NO: 96575
  misc_feature 1..37: note = chr7:148959621-148959658
  misc_feature 1..37: note = Hyper
  source 1..37: mol_type = genomic DNA

SEQ ID NO: 128469 - DNA, 320 bp, Homo sapiens; identical to SEQ ID NO: 96577
  misc_feature 1..320: note = chr7:149111906-149112226
  misc_feature 1..320: note = Hyper
  source 1..320: mol_type = genomic DNA

SEQ ID NO: 128470 - DNA, 139 bp, Homo sapiens
  misc_feature 1..139: note = chr7:149112286-149112425
  misc_feature 1..139: note = Hyper
  source 1..139: mol_type = genomic DNA
taagctatacccccgtcacacgggaggaaagcgtcactcacgtcttcgtagtcagccgcacgcaagccgcgtacagcactgcagggtccgcgctttgggcggcgcttttctccggcggccagttcggacctttgcgctt

SEQ ID NO: 128471 - DNA, 38 bp, Homo sapiens; identical to SEQ ID NO: 96579
  misc_feature 1..38: note = chr7:149118656-149118694
  misc_feature 1..38: note = Hypo
  source 1..38: mol_type = genomic DNA

SEQ ID NO: 128472 - DNA, 184 bp, Homo sapiens; identical to SEQ ID NO: 96580
  misc_feature 1..184: note = chr7:149119889-149120073
  misc_feature 1..184: note = Hyper
  source 1..184: mol_type = genomic DNA

SEQ ID NO: 128473 - DNA, 172 bp, Homo sapiens; identical to SEQ ID NO: 96581
  misc_feature 1..172: note = chr7:149159300-149159472
  misc_feature 1..172: note = Hypo
  source 1..172: mol_type = genomic DNA

SEQ ID NO: 128474 - DNA, 30 bp, Homo sapiens; identical to SEQ ID NO: 96582
  misc_feature 1..30: note = chr7:149184025-149184055
  misc_feature 1..30: note = Hypo
  source 1..30: mol_type = genomic DNA

SEQ ID NO: 128475 - DNA, 32 bp, Homo sapiens; identical to SEQ ID NO: 96583
  misc_feature 1..32: note = chr7:149389639-149389671
  misc_feature 1..32: note = Hyper
  source 1..32: mol_type = genomic DNA

SEQ ID NO: 128476 - DNA, 57 bp, Homo sapiens
  misc_feature 1..57: note = chr7:149389898-149389955
  misc_feature 1..57: note = Hyper
  source 1..57: mol_type = genomic DNA
tgcgacggccggccccgtgcggccccagcccgccctcgcctccgcaccctggggagc

SEQ ID NO: 128477 - DNA, 1070 bp, Homo sapiens
  misc_feature 1..1070: note = chr7:149411339-149412409
  misc_feature 1..1070: note = Hyper
  source 1..1070: mol_type = genomic DNA
cagaggagagtgggccgcgcttccttcccgcatcacacgtttatttgaggcctactatgtgccaggaacaactggggttaccaccccagcaaacaggcacgcaaaatgtgacacgaaggtaggtcatggctgcggcgagcgggggcgcgggcgaaagacgtgaggatgtacgggggcctggcagctgctctgtcccacccacgcccggccggaccctcgacccctttcactccaggtcgggtttccccgaccgcggcctctgggaaagatgggtccctcttcatccccaccatcagcccctggcacatgggacgcgctgagtggtggctgcgggaatgaatgagtgataagcggcgcgtacccgcgggcttgcacgcccacagccgccccggctggtctcggcgcgcaacctctacccgcagctgggggcggggacgaggggagggggcggggacgaggcccgagccaggtccgccccgccctgtctccgccccccgcttccgagccggcgccgcggcgccttctgggaagtgtagtccgcgtctgcgccggccggccgggccgccgaagccgggggctccgggcggaaacggcaccacccaccaagggatgcgaggcgctcggggcgggctcaacgaggccgggggcgggcccgggcgcgcccacccccgcccctccccctcggcccaggcccccggccccgccttctcctgcgcggacctgggccgccgccgacgagggtcgcgtgcgcccgcgccagggcccgcgccggaaaccgaggagtggcggggaggctgagcccggggatggcgcgccaggtaaggcaggcggacgcgcggacccctcggcgcagtgcggccccgaaggcggtagggcgagaaagagctgggacccccccgcaacttcgggatcggctgggtgaggctgggcaggcctgatgctcaggggttcgtgccgggaagttcaggtcctcggacaacctctctccagctctccgccgccggtacccacggcccagtctccacctggggaaacccccttggcgtggcttgtttcgttacaagttatcc

SEQ ID NO: 128478 - DNA, 143 bp, Homo sapiens; identical to SEQ ID NO: 96587
  misc_feature 1..143: note = chr7:149427347-149427490
  misc_feature 1..143: note = Hypo
  source 1..143: mol_type = genomic DNA

SEQ ID NO: 128479 - DNA, 30 bp, Homo sapiens; identical to SEQ ID NO: 96588
  misc_feature 1..30: note = chr7:149480372-149480402
  misc_feature 1..30: note = Hypo
  source 1..30: mol_type = genomic DNA

SEQ ID NO: 128480 - DNA, 30 bp, Homo sapiens; identical to SEQ ID NO: 96589
  misc_feature 1..30: note = chr7:149489914-149489944
  misc_feature 1..30: note = Hypo
  source 1..30: mol_type = genomic DNA

SEQ ID NO: 128481 - DNA, 47 bp, Homo sapiens; identical to SEQ ID NO: 96590
  misc_feature 1..47: note = chr7:149513473-149513520
  misc_feature 1..47: note = Hypo
  source 1..47: mol_type = genomic DNA

SEQ ID NO: 128482 - DNA, 141 bp, Homo sapiens; identical to SEQ ID NO: 96591
  misc_feature 1..141: note = chr7:149518573-149518714
  misc_feature 1..141: note = Hypo
  source 1..141: mol_type = genomic DNA

SEQ ID NO: 128483 - DNA, 40 bp, Homo sapiens; identical to SEQ ID NO: 96592
  misc_feature 1..40: note = chr7:149529824-149529864
  misc_feature 1..40: note = Hypo
  source 1..40: mol_type = genomic DNA

SEQ ID NO: 128484 - DNA, 729 bp, Homo sapiens
  misc_feature 1..729: note = chr7:149744409-149745138
  misc_feature 1..729: note = Hyper
  source 1..729: mol_type = genomic DNA
ccagggaacgtaaggcgaattccagatcccagcaggcgcagtacccaaaccccgctctctccagccaccaactcccggccgccgcggctgcagacacagacccgctccctccgggacggcgatgaccgcgatctggcgccacggagcctgtctgggggcgcccggagagtcgtgggctgggggagggcgcctgattcccccccccacagatgcccccggccgacgcgtctcgctgcgcgctcagcccggagcccccgccgccgtcccccgcccccgagaagctcttacgtcctccttgtcaccatcgctccgcgcctggtactggaaccggggccggccatccgcgccgccgccgccgccgccgccgcgctcccggggcgccgccgcctgcgcccgcgggccgaggggcttggctcctgcgccgccgtcctcctcgggcccctggccgcccaggaggtgactcgcctccgggggcgtggggaaggacctcgaggtgttgatcttgccggtgaacctctggtacagcgaagccatcgggcaccgcgctcctgctggctgtctttagggctttttaatattttgctttctctccggttcccactccccaccccgctccagattaaaaaaaaggcggtggggaggcagcagcagcagcaaggcaagcccagcgccggcgaccgctcctcccgcgcgccactcgcgagtctccgctggcgactctacctggct

SEQ ID NO: 128485 - DNA, 80 bp, Homo sapiens
  misc_feature 1..80: note = chr7:149745575-149745655
  misc_feature 1..80: note = Hyper
  source 1..80: mol_type = genomic DNA
gcggtgggggagtcccgggagctgagggttctgcggccccgccgaaggtagtgctgcgcgtgccccgcagcacgcgagcg

SEQ ID NO: 128486 - DNA, 285 bp, Homo sapiens
  misc_feature 1..285: note = chr7:149917110-149917395
  misc_feature 1..285: note = Hyper
  source 1..285: mol_type = genomic DNA
agccctgctgctggccgcgggtctacaaaacagcatacgttctctcaacccctgcgatccgccaaccatcctcagtcaccgacccctgcaagggatgcagacgcaccagcggctgctcacactccctccacaaacctgccggagtctccactcgcccgccaactgtagcctccatctgcgccccacgcccccgcacaagccccctccgtcgcgggtctcttaccttgtggcctttccccgggggatacctgacgctattggagactcctgcggtttgattcatgt

SEQ ID NO: 128487 - DNA, 504 bp, Homo sapiens
  misc_feature 1..504: note = chr7:149917773-149918277
  misc_feature 1..504: note = Hyper
  source 1..504: mol_type = genomic DNA
ctaggctctttcctgcgcaaggggtggggaaacccgcgaaagccagggagtcgcgcgcactcacgccctcccgccaccagggcagagccaccgctgcaaggagcccacgggtgcgcgctccgctccagggcggatctttccacacccccctcaccctcaaaagctcaggctggagcggtcatcagtgcggactccggcaccccacccacccagcaggggttaaggagggactggtgcccactcttgcctacagctcctgcgcagggctccagccgccaaatcttcccgggatggtcgggaggtggcataagaggttttgccaggaaccactgcacaggcgaaagagagacagtggagtgggcggaggaggagctgggacggcacccgggctcgttagcccaggctgcacgagctacagcggagggatgcgagcgctctgtcagttgagcaggcgctgcgcgcggaggcccggtcggtgccattggttggcggcccaattggctt

SEQ ID NO: 128488 - DNA, 93 bp, Homo sapiens; identical to SEQ ID NO: 41504
  misc_feature 1..93: note = chr7:150049533-150049626
  misc_feature 1..93: note = Hypo
  source 1..93: mol_type = genomic DNA

SEQ ID NO: 128489 - DNA, 1037 bp, Homo sapiens; identical to SEQ ID NO: 96603
  misc_feature 1..1037: note = chr7:150068543-150069580
  misc_feature 1..1037: note = Hypo
  source 1..1037: mol_type = genomic DNA

SEQ ID NO: 128490 - DNA, 523 bp, Homo sapiens; identical to SEQ ID NO: 96604
  misc_feature 1..523: note = chr7:150069934-150070457
  misc_feature 1..523: note = Hypo
  source 1..523: mol_type = genomic DNA

SEQ ID NO: 128491 - DNA, 152 bp, Homo sapiens; identical to SEQ ID NO: 96605
  misc_feature 1..152: note = chr7:150079238-150079390
  misc_feature 1..152: note = Hypo
  source 1..152: mol_type = genomic DNA

SEQ ID NO: 128492 - DNA, 185 bp, Homo sapiens; identical to SEQ ID NO: 96606
  misc_feature 1..185: note = chr7:150081081-150081266
  misc_feature 1..185: note = Hypo
  source 1..185: mol_type = genomic DNA

SEQ ID NO: 128493 - DNA, 48 bp, Homo sapiens; identical to SEQ ID NO: 96607
  misc_feature 1..48: note = chr7:150101959-150102007
  misc_feature 1..48: note = Hyper
  source 1..48: mol_type = genomic DNA

SEQ ID NO: 128494 - DNA, 238 bp, Homo sapiens; identical to SEQ ID NO: 96609
  misc_feature 1..238: note = chr7:150497647-150497885
  misc_feature 1..238: note = Hyper
  source 1..238: mol_type = genomic DNA

SEQ ID NO: 128495 - DNA, 87 bp, Homo sapiens; identical to SEQ ID NO: 96611
  misc_feature 1..87: note = chr7:150554703-150554790
  misc_feature 1..87: note = Hypo
  source 1..87: mol_type = genomic DNA

SEQ ID NO: 128496 - DNA, 30 bp, Homo sapiens; identical to SEQ ID NO: 96612
  misc_feature 1..30: note = chr7:150609213-150609243
  misc_feature 1..30: note = Hypo
  source 1..30: mol_type = genomic DNA

SEQ ID NO: 128497 - DNA, 38 bp, Homo sapiens; identical to SEQ ID NO: 96613
  misc_feature 1..38: note = chr7:150653091-150653129
  misc_feature 1..38: note = Hyper
  source 1..38: mol_type = genomic DNA

SEQ ID NO: 128498 - DNA, 203 bp, Homo sapiens
  misc_feature 1..203: note = chr7:150655182-150655385
  misc_feature 1..203: note = Hyper
  source 1..203: mol_type = genomic DNA
cggcgcgcatggcctcgatgtcgtcggccgacgaggcgcggcgcacgctggcgcagctttctcgggagcgcgtccgggccaggctgcagctggagcccgaggcgtcggggttgaggctgtgcgcccggggcgatgggagctggccgggcgcgctgcggggcggagagccgggacccaccagcgcacgccgctcctccgcgggc

SEQ ID NO: 128499 - DNA, 30 bp, Homo sapiens; identical to SEQ ID NO: 96614
  misc_feature 1..30: note = chr7:150660247-150660277
  misc_feature 1..30: note = Hyper
  source 1..30: mol_type = genomic DNA

SEQ ID NO: 128500 - DNA, 243 bp, Homo sapiens; identical to SEQ ID NO: 96615
  misc_feature 1..243: note = chr7:150715080-150715323
  misc_feature 1..243: note = Hyper
  source 1..243: mol_type = genomic DNA

SEQ ID NO: 128501 - DNA, 742 bp, Homo sapiens; identical to SEQ ID NO: 96616
  misc_feature 1..742: note = chr7:150715618-150716360
  misc_feature 1..742: note = Hyper
  source 1..742: mol_type = genomic DNA

SEQ ID NO: 128502 - DNA, 294 bp, Homo sapiens; identical to SEQ ID NO: 96617
  misc_feature 1..294: note = chr7:150746049-150746343
  misc_feature 1..294: note = Hypo
  source 1..294: mol_type = genomic DNA

SEQ ID NO: 128503 - DNA, 542 bp, Homo sapiens; identical to SEQ ID NO: 96618
  misc_feature 1..542: note = chr7:150748043-150748585
  misc_feature 1..542: note = Hyper
  source 1..542: mol_type = genomic DNA

SEQ ID NO: 128504 - DNA, 156 bp, Homo sapiens; identical to SEQ ID NO: 96619
  misc_feature 1..156: note = chr7:150753912-150754068
  misc_feature 1..156: note = Hypo
  source 1..156: mol_type = genomic DNA

SEQ ID NO: 128505 - DNA, 267 bp, Homo sapiens; identical to SEQ ID NO: 96620
  misc_feature 1..267: note = chr7:150758966-150759233
  misc_feature 1..267: note = Hypo
  source 1..267: mol_type = genomic DNA

SEQ ID NO: 128506 - DNA, 171 bp, Homo sapiens; identical to SEQ ID NO: 96621
  misc_feature 1..171: note = chr7:150773894-150774065
  misc_feature 1..171: note = Hypo
  source 1..171: mol_type = genomic DNA

SEQ ID NO: 128507 - DNA, 33 bp, Homo sapiens; identical to SEQ ID NO: 41512
  misc_feature 1..33: note = chr7:150774325-150774358
  misc_feature 1..33: note = Hypo
  source 1..33: mol_type = genomic DNA

SEQ ID NO: 128508 - DNA, 153 bp, Homo sapiens; identical to SEQ ID NO: 96623
  misc_feature 1..153: note = chr7:150774704-150774857
  misc_feature 1..153: note = Hypo
  source 1..153: mol_type = genomic DNA

SEQ ID NO: 128509 - DNA, 73 bp, Homo sapiens; identical to SEQ ID NO: 41514
  misc_feature 1..73: note = chr7:150811286-150811359
  misc_feature 1..73: note = Hypo
  source 1..73: mol_type = genomic DNA

SEQ ID NO: 128510 - DNA, 30 bp, Homo sapiens; identical to SEQ ID NO: 96625
  misc_feature 1..30: note = chr7:150813180-150813210
  misc_feature 1..30: note = Hypo
  source 1..30: mol_type = genomic DNA

SEQ ID NO: 128511 - DNA, 330 bp, Homo sapiens; identical to SEQ ID NO: 41515
  misc_feature 1..330: note = chr7:150823565-150823895
  misc_feature 1..330: note = Hypo
  source 1..330: mol_type = genomic DNA

SEQ ID NO: 128512 - DNA, 30 bp, Homo sapiens; identical to SEQ ID NO: 96627
  misc_feature 1..30: note = chr7:150826816-150826846
  misc_feature 1..30: note = Hypo
  source 1..30: mol_type = genomic DNA

SEQ ID NO: 128513 - DNA, 705 bp, Homo sapiens
  misc_feature 1..705: note = chr7:150864219-150864924
  misc_feature 1..705: note = Hyper
  source 1..705: mol_type = genomic DNA
ggctcggggttgtttcgggcggcagtggcggcggcggcggcagcggcggcggcgagctcctggggcccgtagaaagcgtcgggcggctccgcgaagctgggcagcgcggtggtcagcgccaccatcgagggcacagcctgacccagccccgcgcagaaggtgttggtaaggcggccggcgaaagaggctagcggggcgaggggcgggaggccagcgggcagcggcgcaggggccagcgcctgcggcagcacgagcggccggtagggcatgaacatggggtagccggtgtacagcaagtggccggagcgcggcggcggcggcccgattagggagtcgatggagaaggcagtgcccgggcccccgccgccgcccccgccgttgcccccaggggcgctaccgcctccggcccgctgcatcttgttcggagctgcggccgccccggggcgctcctctctgggcgcctccgtgcgccccgcggctcgggcgccccgcgcggacacgcagggctcgctccctggctcccgggccgaggtggcggcggggcgcgggctcggcgcagtgtggctccggcgccgcgctccctctctctcataaggagggagggggcgggcgagcaggcgggctgggggtgtcgccctccggactcatccatcttcctcaaattacgcttcatttcctccctccgcccgccgccgccgcgcccgg

SEQ ID NO: 128514 - DNA, 399 bp, Homo sapiens; identical to SEQ ID NO: 96630
  misc_feature 1..399: note = chr7:150870816-150871215
  misc_feature 1..399: note = Hypo
  source 1..399: mol_type = genomic DNA

SEQ ID NO: 128515 - DNA, 136 bp, Homo sapiens; identical to SEQ ID NO: 96631
  misc_feature 1..136: note = chr7:150872876-150873012
  misc_feature 1..136: note = Hypo
  source 1..136: mol_type = genomic DNA

SEQ ID NO: 128516 - DNA, 83 bp, Homo sapiens; identical to SEQ ID NO: 96632
  misc_feature 1..83: note = chr7:150884625-150884708
  misc_feature 1..83: note = Hypo
  source 1..83: mol_type = genomic DNA

SEQ ID NO: 128517 - DNA, 30 bp, Homo sapiens; identical to SEQ ID NO: 96633
  misc_feature 1..30: note = chr7:151077135-151077165
  misc_feature 1..30: note = Hypo
  source 1..30: mol_type = genomic DNA

SEQ ID NO: 128518 - DNA, 76 bp, Homo sapiens; identical to SEQ ID NO: 96634
  misc_feature 1..76: note = chr7:151082136-151082212
  misc_feature 1..76: note = Hypo
  source 1..76: mol_type = genomic DNA

SEQ ID NO: 128519 - DNA, 48 bp, Homo sapiens; identical to SEQ ID NO: 96635
  misc_feature 1..48: note = chr7:151088640-151088688
  misc_feature 1..48: note = Hypo
  source 1..48: mol_type = genomic DNA

SEQ ID NO: 128520 - DNA, 1635 bp, Homo sapiens
  misc_feature 1..1635: note = chr7:151106208-151107843
  misc_feature 1..1635: note = Hyper
  source 1..1635: mol_type = genomic DNA
agggagatttcctgccgctggttgacaaatgatcttcgcctttgtagcggacgcccctcgacccacccacccgatcccggccgcaccctgctctgcacccgcaccccacccccagacctcaccctgccctgccgtgcgctcaacagccagatgctgggcccagacaagcgctcttccgctagtgtgccgggatgagcgggggctggacttctagaaaggggtctgcgggcgcaggagctggggtccgcggtctggggccggtgagctgcggcgaagaggtcagggagggagtgggagggtctaccttgcaggagcgcgcagcactggccgtccgcggtgctccagagccgggccgtgccgtcctcgctgcccgtcagcaggcgctgcccgtcggggctcaggctcagccagttgatgcccccgcggtggtcggcgcagaccctcagggccgacccgccgccccccatcccgctggcagggcggggaacaagaaggagctgcgccccgctagggaggggcgccccggggtccgcgcggcggctccgtacgactgcggcccgcggccatcgcggggaacggggagcccgactcctgcggaggcacgcggcgaggggagggtgaaggaccctagctccccgctgcctccagcctctgggcccgcgaacccagggcgctgcggggggcggcccactcgggacctccgccctgggtagagtcctgggcgcgcgggcagagagaacccccttcccagcaccgctcggaggatccacaccccaccgggcgaacaaggcagctgcgtctctggtgcacaaggagccccccgcctcctctcgcgcccacggggctggggcggggagaggaacacgggaagccgagcgccccgcgccctccccggccgagcgcggaacaatacggtccagcctggctcctcctcagagaccacccctcacccgatcccctcccacttctcgggctgcgccccagcccccaccccgcgcgcctgcagcctccccccttcgtcgctgtgcgggtccgggggacggctccacgtgcgaccctcctagctgcccgggctgcgcctctgggctctggcctctgccacctccgccgccgccgcctgggtcccctgagccaagggccgggacgagggagggggaggcggacaaagggtcggggtcggggagaatcgcgcgccgggaactcatttggggcgcagctccaccgacccctcggctactcgcctccaccaggcaagccaggtcctcccatgctctgagccctaaggactctgcccgaggggctctcggggacttgggggcggtcccccaatggagggtgcgacagggaaagccccgagtccgccctccctgggaaatcacgcgcacacccaggattctactttggtctggccggagtggggatgaggtgcgagccgctgcggggtcggtggagccgggatgtcaagttcaccttccagccgccgcgggctccctcggcctggggcgcctctaatggaccccggggtcggcctgagccctcccggagcgcccggcggctggtttccattagggcagttccggcgccgacttcgctggggacggggaaggtgacccccctactcggatcccccaggtc

SEQ ID NO: 128521 - DNA, 81 bp, Homo sapiens; identical to SEQ ID NO: 96640
  misc_feature 1..81: note = chr7:151137032-151137113
  misc_feature 1..81: note = Hyper
  source 1..81: mol_type = genomic DNA

SEQ ID NO: 128522 - DNA, 417 bp, Homo sapiens; identical to SEQ ID NO: 96641
  misc_feature 1..417: note = chr7:151145500-151145917
  misc_feature 1..417: note = Hyper
  source 1..417: mol_type = genomic DNA

SEQ ID NO: 128523 - DNA, 30 bp, Homo sapiens; identical to SEQ ID NO: 96642
  misc_feature 1..30: note = chr7:151423801-151423831
  misc_feature 1..30: note = Hypo
  source 1..30: mol_type = genomic DNA

SEQ ID NO: 128524 - DNA, 32 bp, Homo sapiens; identical to SEQ ID NO: 96643
  misc_feature 1..32: note = chr7:151501814-151501846
  misc_feature 1..32: note = Hypo
  source 1..32: mol_type = genomic DNA

SEQ ID NO: 128525 - DNA, 175 bp, Homo sapiens; identical to SEQ ID NO: 96644
  misc_feature 1..175: note = chr7:151553599-151553774
  misc_feature 1..175: note = Hypo
  source 1..175: mol_type = genomic DNA

SEQ ID NO: 128526 - DNA, 72 bp, Homo sapiens; identical to SEQ ID NO: 96645
  misc_feature 1..72: note = chr7:151569929-151570001
  misc_feature 1..72: note = Hypo
  source 1..72: mol_type = genomic DNA

SEQ ID NO: 128527 - DNA, 198 bp, Homo sapiens; identical to SEQ ID NO: 96646
  misc_feature 1..198: note = chr7:151574921-151575119
  misc_feature 1..198: note = Hyper
  source 1..198: mol_type = genomic DNA

SEQ ID NO: 128528 - DNA, 30 bp, Homo sapiens; identical to SEQ ID NO: 41520
  misc_feature 1..30: note = chr7:151585396-151585426
  misc_feature 1..30: note = Hypo
  source 1..30: mol_type = genomic DNA

SEQ ID NO: 128529 - DNA, 30 bp, Homo sapiens; identical to SEQ ID NO: 96648
  misc_feature 1..30: note = chr7:151585720-151585750
  misc_feature 1..30: note = Hypo
  source 1..30: mol_type = genomic DNA

SEQ ID NO: 128530 - DNA, 336 bp, Homo sapiens; identical to SEQ ID NO: 96649
  misc_feature 1..336: note = chr7:151591649-151591985
  misc_feature 1..336: note = Hypo
  source 1..336: mol_type = genomic DNA

SEQ ID NO: 128531 - DNA, 185 bp, Homo sapiens; identical to SEQ ID NO: 96651
  misc_feature 1..185: note = chr7:151706792-151706977
  misc_feature 1..185: note = Hypo
  source 1..185: mol_type = genomic DNA

SEQ ID NO: 128532 - DNA, 30 bp, Homo sapiens; identical to SEQ ID NO: 96652
  misc_feature 1..30: note = chr7:151717267-151717297
  misc_feature 1..30: note = Hypo
  source 1..30: mol_type = genomic DNA

SEQ ID NO: 128533 - DNA, 36 bp, Homo sapiens; identical to SEQ ID NO: 96653
  misc_feature 1..36: note = chr7:151723170-151723206
  misc_feature 1..36: note = Hyper
  source 1..36: mol_type = genomic DNA

SEQ ID NO: 128534 - DNA, 38 bp, Homo sapiens; identical to SEQ ID NO: 96654
  misc_feature 1..38: note = chr7:151812801-151812839
  misc_feature 1..38: note = Hypo
  source 1..38: mol_type = genomic DNA

SEQ ID NO: 128535 - DNA, 21 bp, Homo sapiens
  misc_feature 1..21: note = chr7:152085353-152085374
  misc_feature 1..21: note = Hypo
  source 1..21: mol_type = genomic DNA
tatgctctggccaggcgtggt

SEQ ID NO: 128536 - DNA, 196 bp, Homo sapiens; identical to SEQ ID NO: 96656
  misc_feature 1..196: note = chr7:152159631-152159827
  misc_feature 1..196: note = Hypo
  source 1..196: mol_type = genomic DNA

SEQ ID NO: 128537 - DNA, 40 bp, Homo sapiens; identical to SEQ ID NO: 41523
  misc_feature 1..40: note = chr7:152337514-152337554
  misc_feature 1..40: note = Hypo
  source 1..40: mol_type = genomic DNA

SEQ ID NO: 128538 - DNA, 79 bp, Homo sapiens; identical to SEQ ID NO: 96658
  misc_feature 1..79: note = chr7:152371357-152371436
  misc_feature 1..79: note = Hypo
  source 1..79: mol_type = genomic DNA

SEQ ID NO: 128539 - DNA, 19 bp, Homo sapiens
  misc_feature 1..19: note = chr7:152374378-152374397
  misc_feature 1..19: note = Hypo
  source 1..19: mol_type = genomic DNA
agcttaggcctgaatcgtg

SEQ ID NO: 128540 - DNA, 138 bp, Homo sapiens; identical to SEQ ID NO: 96660
  misc_feature 1..138: note = chr7:152537420-152537558
  misc_feature 1..138: note = Hypo
  source 1..138: mol_type = genomic DNA

SEQ ID NO: 128541 - DNA, 30 bp, Homo sapiens; identical to SEQ ID NO: 96661
  misc_feature 1..30: note = chr7:152603655-152603685
  misc_feature 1..30: note = Hypo
  source 1..30: mol_type = genomic DNA

SEQ ID NO: 128542 - DNA, 738 bp, Homo sapiens
  misc_feature 1..738: note = chr7:152622496-152623234
  misc_feature 1..738: note = Hyper
  source 1..738: mol_type = genomic DNA
gggaacggtggaggccgccgttctcttgggcgcggcctctgctgggggacggcggggatcgcagggccgaggggccgggcgcgcgcgggggagggacccaggccaggggccgctcgcctcggggcggggtctctggagagcgcgcagaggggacgcttcgtgaatgcctgccggcctgaaggatgtcgctgatctctgcccccttcgccaaggccgggccaggcgagtaggggcgcggcctgagcccctgcggtgattccccaggtgtggaatcaaaacagatcccagagcgcgatccgcggggcttttggaaggagccgcccagggctggagattccgacgcaaagacccggaggcccgcggagctgtgggcgcagctggagatggcggaggccccagcagggagtgggggctcggggtccgcagaggcagctccatccccggcgctgggggccgcatggttcccgcaggctgtggccaatcgaggaccgggctccgcattcttcagacgttcctgagccccctcttgccccaacgtccccctcccgggcagccccacagtgggcgattttcccgcactccgcacgagtccatccccatggtggactaggggccgggtctaggctctgcgctacccggccagagcgtccagcggccccactgggcggcggcgccacgcggacgtgggtgggaacagcccccggacccgccgggagaccctcgcggggaagagaagcc

SEQ ID NO: 128543 - DNA, 175 bp, Homo sapiens; identical to SEQ ID NO: 15049
  misc_feature 1..175: note = chr7:152693809-152693984
  misc_feature 1..175: note = Hypo
  source 1..175: mol_type = genomic DNA

SEQ ID NO: 128544 - DNA, 42 bp, Homo sapiens; identical to SEQ ID NO: 96666
  misc_feature 1..42: note = chr7:152775969-152776011
  misc_feature 1..42: note = Hypo
  source 1..42: mol_type = genomic DNA

SEQ ID NO: 128545 - DNA, 210 bp, Homo sapiens; identical to SEQ ID NO: 96667
  misc_feature 1..210: note = chr7:152782995-152783205
  misc_feature 1..210: note = Hypo
  source 1..210: mol_type = genomic DNA

SEQ ID NO: 128546 - DNA, 34 bp, Homo sapiens; identical to SEQ ID NO: 41526
  misc_feature 1..34: note = chr7:152984071-152984105
  misc_feature 1..34: note = Hypo
  source 1..34: mol_type = genomic DNA

SEQ ID NO: 128547 - DNA, 23 bp, Homo sapiens
  misc_feature 1..23: note = chr7:153041593-153041616
  misc_feature 1..23: note = Hypo
  source 1..23: mol_type = genomic DNA
tttttttttttgagacggagtct

SEQ ID NO: 128548 - DNA, 22 bp, Homo sapiens
  misc_feature 1..22: note = chr7:153041856-153041878
  misc_feature 1..22: note = Hypo
  source 1..22: mol_type = genomic DNA
ttacaggcgtaagccaacaagc

SEQ ID NO: 128549 - DNA, 198 bp, Homo sapiens; identical to SEQ ID NO: 96671
  misc_feature 1..198: note = chr7:153102258-153102456
  misc_feature 1..198: note = Hypo
  source 1..198: mol_type = genomic DNA

SEQ ID NO: 128550 - DNA, 30 bp, Homo sapiens; identical to SEQ ID NO: 31625
  misc_feature 1..30: note = chr7:153445126-153445156
  misc_feature 1..30: note = Hyper
  source 1..30: mol_type = genomic DNA

SEQ ID NO: 128551 - DNA, 245 bp, Homo sapiens
  misc_feature 1..245: note = chr7:153446047-153446292
  misc_feature 1..245: note = Hyper
  source 1..245: mol_type = genomic DNA
aggagtctccaatagcgtcaggtgtcccccggggaaaggccacaaggtaagggaccagcgacggagggggcttgtgcgggggcgtggggcgcagatggaggctacagttggccggagagtggagactccggcaggtttgtggagggagtgtgagcagccgctggtgcgtctgcatgccttgcaggggtcggtgactgaggatggttggcggatcgcgggggttgagagaacgtgtgctgttttgt

SEQ ID NO: 128552 - DNA, 22 bp, Homo sapiens
  misc_feature 1..22: note = chr7:153505321-153505343
  misc_feature 1..22: note = Hypo
  source 1..22: mol_type = genomic DNA
gcgtgtgtgcacgtgcgtgcgt

SEQ ID NO: 128553 - DNA, 38 bp, Homo sapiens; identical to SEQ ID NO: 96676
  misc_feature 1..38: note = chr7:153519547-153519585
  misc_feature 1..38: note = Hypo
  source 1..38: mol_type = genomic DNA

SEQ ID NO: 128554 - DNA, 80 bp, Homo sapiens; identical to SEQ ID NO: 41529
  misc_feature 1..80: note = chr7:153540019-153540099
  misc_feature 1..80: note = Hypo
  source 1..80: mol_type = genomic DNA

SEQ ID NO: 128555 - DNA, 1168 bp, Homo sapiens
  misc_feature 1..1168: note = chr7:153583302-153584470
  misc_feature 1..1168: note = Hyper
  source 1..1168: mol_type = genomic DNA
tttgaccaacctctgcgcgcgctcctgggagcgcgcatctgtgtgtggtccagggagccaaccgcgtttgtgaatggatgattgatgggaacagcgcccaggggcagcaggtggagacgggaacccaggtcgcggtcactggtcaacccgcctcttggggtggaggttagagaaatgggcgctgggatttggccccggccagtgctggggttccagggtagggagagccgtgggcgccagactgggctgcgggaggtcttcggggtcagatcccgcaggcagccaagagcgagccaaagaaacaaagccgccgagggacgcggctggggcggaggcccggagggaagtggaggccgggaagccaggtgtgcggcggggagagcggcccctgccacccgcgctggtagccgggcgctgccattcactgcaaggtcctctgcgccctggaattgccgcggcggcggatgcagaggccaacccagagtgcaaccatggagacgcgacgtgtgtcccatagtaacctgttacaacattatttataagctgccatccctagccttcccccgcttcccctccgctccctcgccagacttgcgggcgacgggcacagccgcgtctggctcttcccggcctctcccttctctcgcgggcgcagccgatcaatagttaacacccggctgcggacggcggctccatccgcggcaatcaccgtagtgcttgtttgtggaagccgagcgtgcgtgcgccgcgcgcgcacccagtccagcgcggagtgggcgtctacccgaggaggggtgtctggggaggggctgccctcgttacccaaacagtttgcgctcgcttaaccttgatgcagctcgaggcttcccagtccagctcagttcagacagaaaacctggcgcgcgcgcgcgcacacacacacgcctcccctggcgtcgccgcccggccgggtccctgcccttagggaccagagcggcgaccgctgcaccccgcaccgcctgctggaggagcccccggagccggggccgagccgccggcgtccccgagtgcgccccctgtgcgtgccgccgcgctgttgctcgcagtgtgctggcgccgagctcggtggacacgcgcgcagtcagagctgcctctcgccctcgctagctgggctcgcagcctcttcctc

SEQ ID NO: 128556 - DNA, 368 bp, Homo sapiens; identical to SEQ ID NO: 96680
  misc_feature 1..368: note = chr7:153584779-153585147
  misc_feature 1..368: note = Hyper
  source 1..368: mol_type = genomic DNA

SEQ ID NO: 128557 - DNA, 188 bp, Homo sapiens
  misc_feature 1..188: note = chr7:153585418-153585606
  misc_feature 1..188: note = Hyper
  source 1..188: mol_type = genomic DNA
gtcccccaggagggccgcgtgcctggaaacgcggctggtccgcggaaggctccgggcagctggccaggggacagttctgcacggataactttctaagtggaggacccggcgatccgcctccccagcgagcccacccgcctcgccgctccccgctgacccgcgcggcctgggcgcgcctgctctcgggc

SEQ ID NO: 128558 - DNA, 30 bp, Homo sapiens; identical to SEQ ID NO: 41530
  misc_feature 1..30: note = chr7:153641678-153641708
  misc_feature 1..30: note = Hypo
  source 1..30: mol_type = genomic DNA

SEQ ID NO: 128559 - DNA, 672 bp, Homo sapiens
  misc_feature 1..672: note = chr7:153749653-153750325
  misc_feature 1..672: note = Hyper
  source 1..672: mol_type = genomic DNA
agagccccggcttcgcgagccgccggggagggggcggaggaggctgagccaggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgtaagagcttctcgggggcggggggcggcggcgggttctccgggctgagcgcgcagcgagacgcgtcggcaggggaaattttttttggggggggaatcaggcgccctccccccgcccacgactctccgggcgcccccagacaggctccgtggcgccagatcgcggtcaccgcgtccc

SEQ ID NO: 128560 - DNA, 30 bp, Homo sapiens; identical to SEQ ID NO: 96685
  misc_feature 1..30: note = chr7:153789907-153789937
  misc_feature 1..30: note = Hypo
  source 1..30: mol_type = genomic DNA

SEQ ID NO: 128561 - DNA, 324 bp, Homo sapiens; identical to SEQ ID NO: 96686
  misc_feature 1..324: note = chr7:153820811-153821135
  misc_feature 1..324: note = Hypo
  source 1..324: mol_type = genomic DNA

SEQ ID NO: 128562 - DNA, 30 bp, Homo sapiens; identical to SEQ ID NO: 41531
  misc_feature 1..30: note = chr7:153896397-153896427
  misc_feature 1..30: note = Hypo
  source 1..30: mol_type = genomic DNA

SEQ ID NO: 128563 - DNA, 21 bp, Homo sapiens
  misc_feature 1..21: note = chr7:154002068-154002089
  misc_feature 1..21: note = Hyper
  source 1..21: mol_type = genomic DNA
cgtctccgcggcagtcgctgc

SEQ ID NO: 128564 - DNA, 30 bp, Homo sapiens; identical to SEQ ID NO: 96689
  misc_feature 1..30: note = chr7:154062573-154062603
  misc_feature 1..30: note = Hypo
  source 1..30: mol_type = genomic DNA

SEQ ID NO: 128565 - DNA, 30 bp, Homo sapiens; identical to SEQ ID NO: 96690
  misc_feature 1..30: note = chr7:154063085-154063115
  misc_feature 1..30: note = Hypo
  source 1..30: mol_type = genomic DNA

SEQ ID NO: 128566 - DNA, 30 bp, Homo sapiens; identical to SEQ ID NO: 96691
  misc_feature 1..30: note = chr7:154065573-154065603
  misc_feature 1..30: note = Hypo
  source 1..30: mol_type = genomic DNA

SEQ ID NO: 128567 - DNA, 40 bp, Homo sapiens; identical to SEQ ID NO: 41532
  misc_feature 1..40: note = chr7:154088244-154088284
  misc_feature 1..40: note = Hypo
  source 1..40: mol_type = genomic DNA

SEQ ID NO: 128568 - DNA, 66 bp, Homo sapiens; identical to SEQ ID NO: 96693
  misc_feature 1..66: note = chr7:154186455-154186521
  misc_feature 1..66: note = Hypo
  source 1..66: mol_type = genomic DNA

SEQ ID NO: 128569 - DNA, 30 bp, Homo sapiens; identical to SEQ ID NO: 96696
  misc_feature 1..30: note = chr7:154438196-154438226
  misc_feature 1..30: note = Hypo
  source 1..30: mol_type = genomic DNA

SEQ ID NO: 128570 - DNA, 30 bp, Homo sapiens; identical to SEQ ID NO: 96697
  misc_feature 1..30: note = chr7:154468234-154468264
  misc_feature 1..30: note = Hypo
  source 1..30: mol_type = genomic DNA

SEQ ID NO: 128571 - DNA, 30 bp, Homo sapiens; identical to SEQ ID NO: 96698
  misc_feature 1..30: note = chr7:154486585-154486615
  misc_feature 1..30: note = Hypo
  source 1..30: mol_type = genomic DNA

SEQ ID NO: 128572 - DNA, 30 bp, Homo sapiens; identical to SEQ ID NO: 96699
  misc_feature 1..30: note = chr7:154540210-154540240
  misc_feature 1..30: note = Hypo
  source 1..30: mol_type = genomic DNA

SEQ ID NO: 128573 - DNA, 219 bp, Homo sapiens; identical to SEQ ID NO: 96700
  misc_feature 1..219: note = chr7:154542071-154542290
  misc_feature 1..219: note = Hypo
  source 1..219: mol_type = genomic DNA

SEQ ID NO: 128574 - DNA, 39 bp, Homo sapiens; identical to SEQ ID NO: 15050
  misc_feature 1..39: note = chr7:154561150-154561189
  misc_feature 1..39: note = Hypo
  source 1..39: mol_type = genomic DNA

SEQ ID NO: 128575 - DNA, 153 bp, Homo sapiens; identical to SEQ ID NO: 96702
  misc_feature 1..153: note = chr7:154597586-154597739
  misc_feature 1..153: note = Hypo
  source 1..153: mol_type = genomic DNA

SEQ ID NO: 128576 - DNA, 71 bp, Homo sapiens; identical to SEQ ID NO: 96703
  misc_feature 1..71: note = chr7:154622694-154622765
  misc_feature 1..71: note = Hypo
  source 1..71: mol_type = genomic DNA

SEQ ID NO: 128577 - DNA, 153 bp, Homo sapiens; identical to SEQ ID NO: 96704
  misc_feature 1..153: note = chr7:154665013-154665166
  misc_feature 1..153: note = Hypo
  source 1..153: mol_type = genomic DNA

SEQ ID NO: 128578 - DNA, 34 bp, Homo sapiens; identical to SEQ ID NO: 96705
  misc_feature 1..34: note = chr7:154667699-154667733
  misc_feature 1..34: note = Hypo
  source 1..34: mol_type = genomic DNA

SEQ ID NO: 128579 - DNA, 41 bp, Homo sapiens; identical to SEQ ID NO: 41536
  misc_feature 1..41: note = chr7:154670093-154670134
  misc_feature 1..41: note = Hypo
  source 1..41: mol_type = genomic DNA

SEQ ID NO: 128580 - DNA, 30 bp, Homo sapiens; identical to SEQ ID NO: 96707
  misc_feature 1..30: note = chr7:154674338-154674368
  misc_feature 1..30: note = Hypo
  source 1..30: mol_type = genomic DNA

SEQ ID NO: 128581 - DNA, 30 bp, Homo sapiens; identical to SEQ ID NO: 96708
  misc_feature 1..30: note = chr7:154675853-154675883
  misc_feature 1..30: note = Hypo
  source 1..30: mol_type = genomic DNA

SEQ ID NO: 128582 - DNA, 30 bp, Homo sapiens; identical to SEQ ID NO: 96709
  misc_feature 1..30: note = chr7:154687918-154687948
  misc_feature 1..30: note = Hypo
  source 1..30: mol_type = genomic DNA

SEQ ID NO: 128583 - DNA, 30 bp, Homo sapiens; identical to SEQ ID NO: 96710
  misc_feature 1..30: note = chr7:154697056-154697086
  misc_feature 1..30: note = Hypo
  source 1..30: mol_type = genomic DNA

SEQ ID NO: 128584 - DNA, 30 bp, Homo sapiens; identical to SEQ ID NO: 96711
  misc_feature 1..30: note = chr7:154708250-154708280
  misc_feature 1..30: note = Hypo
  source 1..30: mol_type = genomic DNA

SEQ ID NO: 128585 - DNA, 741 bp, Homo sapiens
  misc_feature 1..741: note = chr7:154861690-154862431
  misc_feature 1..741: note = Hyper
  source 1..741: mol_type = genomic DNA
ccacccctagagggacgtgtgggggtggctaggggaacgttttgaggaaagttcattggtcaacttgttcaacgtggcaaactcatttcaggcaagagaggcagcaccgtggacagcgccaaccctcctgctcccgggcggggcgaggtggcagcaccgcggacagcaccacatgtggtggcgcacactgggagccgccaggcgcggggagcgcagcagcaccgcggacagccccaaagccgcgcgctctgagccaggaggcggggagagatggccttatcagctgatggcttacgtagggctagatctccacttggataaggcaggtctcggtgggcgcgccagcattcgctctccggagctgcagcctccgaaggggtggcgggggcaacagggacagaaggcaggtcccagaaagcaggttcccccaaaactggcttccctagcacggagttaaggctgcagccggctgcctagagagaagggtgggcagggagacaacgcggtgagagcgactgctctgacgcaccagcccctctcctgcacccacacgctgctggccgcccagcttctccccgatctgggagatgctcggctctgggcggccaaacagcctttccaccaaggcgaggagccctgggctcctgacagcttaggcgggccctggctgcgacacgcagcccctcgcctctgcttccttagcctctgagggcttcagacctgccgcgcttgcagccacac

SEQ ID NO: 128586 - DNA, 133 bp, Homo sapiens; identical to SEQ ID NO: 96715
  misc_feature 1..133: note = chr7:154922507-154922640
  misc_feature 1..133: note = Hypo
  source 1..133: mol_type = genomic DNA

SEQ ID NO: 128587 - DNA, 203 bp, Homo sapiens; identical to SEQ ID NO: 96716
  misc_feature 1..203: note = chr7:154926142-154926345
  misc_feature 1..203: note = Hypo
  source 1..203: mol_type = genomic DNA

SEQ ID NO: 128588 - DNA, 30 bp, Homo sapiens; identical to SEQ ID NO: 96717
  misc_feature 1..30: note = chr7:154959001-154959031
  misc_feature 1..30: note = Hypo
  source 1..30: mol_type = genomic DNA

SEQ ID NO: 128589 - DNA, 30 bp, Homo sapiens; identical to SEQ ID NO: 96718
  misc_feature 1..30: note = chr7:154982436-154982466
  misc_feature 1..30: note = Hyper
  source 1..30: mol_type = genomic DNA

SEQ ID NO: 128590 - DNA, 114 bp, Homo sapiens; identical to SEQ ID NO: 96719
  misc_feature 1..114: note = chr7:155018128-155018242
  misc_feature 1..114: note = Hypo
  source 1..114: mol_type = genomic DNA

SEQ ID NO: 128591 - DNA, 145 bp, Homo sapiens; identical to SEQ ID NO: 96720
  misc_feature 1..145: note = chr7:155052879-155053024
  misc_feature 1..145: note = Hypo
  source 1..145: mol_type = genomic DNA

SEQ ID NO: 128592 - DNA, 51 bp, Homo sapiens; identical to SEQ ID NO: 96721
  misc_feature 1..51: note = chr7:155053384-155053435
  misc_feature 1..51: note = Hypo
  source 1..51: mol_type = genomic DNA

SEQ ID NO: 128593 - DNA, 162 bp, Homo sapiens; identical to SEQ ID NO: 96722
  misc_feature 1..162: note = chr7:155130632-155130794
  misc_feature 1..162: note = Hypo
  source 1..162: mol_type = genomic DNA

SEQ ID NO: 128594 - DNA, 44 bp, Homo sapiens; identical to SEQ ID NO: 41539
  misc_feature 1..44: note = chr7:155133192-155133236
  misc_feature 1..44: note = Hypo
  source 1..44: mol_type = genomic DNA

SEQ ID NO: 128595 - DNA, 145 bp, Homo sapiens; identical to SEQ ID NO: 96724
  misc_feature 1..145: note = chr7:155144931-155145076
  misc_feature 1..145: note = Hypo
  source 1..145: mol_type = genomic DNA

SEQ ID NO: 128596 - DNA, 3494 bp, Homo sapiens
  misc_feature 1..3494: note = chr7:155164415-155167909
  misc_feature 1..3494: note = Hyper
  source 1..3494: mol_type = genomic DNA
aacaacttcgtgacccgctccatcccctctttccctgttgcaaggcgagcggaccgcgctgcacgggtccaggctgggtgcccctctcccctggggtaaagaggcagcacaggttgggacagctagatgggggcaatccaggcgtcctgcccacggtttcctgggagccaacaaaggcgccgagacctcacccgtgtgaggcaaccgccccgtggtcccacagagcttctggaagtctgcgtcccggccttcccgatgcaaggcgccctctccacctgcctcggccgtgagcaggttcaggagggcgagaaaggttaggccgagcggaaccgcgcggccagcgttacgcagggtgccctggacacccctaggcgcccacctggacttgttcccacctcctctcgccccttgccttcttaacccgcattacccgtgtaggcctggggtggaatcggactacttgttcgggatttgctcgagaacattctagggagaaggcacgcccggctttgggcttggccgagagtttagggcaggagcgccggcggggagctccccgggtgctggagaatgcgtgtccggaaagaagtagggcgcgcttcgtggatgcaaccagggccgtctcgcgcactttcttcctaccctgggacagcgcctgaactggagctgggcgcacacactttacggagccagctcgggttcttacgccctggctcacccccgcccgccgccccaggatgcaggtgctgcggcgctccctggtagcctcccgcgctccctgggggcgcgctttcctccatttcagggaagtccccggacaggtgcccacgttttacgctgtccggtagaagcccgcgggctcaggccgacttgcgcggccgcttctccccagggagagaagctggagcttcccccacgcggccctaaggcggggccggctgggccggagtgggcgcggccagggtgtcccagcgcgccccctgccgaccgcgcgctgcggggggcaactccacctcccctggggaggcctcgtccccgctgcagggagactaaagcgtgggtccgcgaccagccggtttaggaacgaaaactctggaactaaaaacaaaaaataaaactggtgagtgcgcagcgtggtcagtgtttccctctgggtaatgcttggccaagggggaagatcgagtactcccgcccacatccgcctcccccaggagggaggattccctctctgctcacccaccctgacccacgcctcccgccaggtccactgctcagacaaatctgtaggtttctgagtatccgtatctcgaaaagcttcaatgcacaaacgaggttttaagcccatcgcggcttcgcaaggggaaggggctgcttccctaaaaacaaaacacaacaaaaaaggcaagggggtactcttgcagatggactggaattagtaatttagccagggtctcttccaaactcactgcaaaattcgccagcgtctcattcttcacacacggggcaccacacgagaatcaccccctccccagaattttgcaaagcacgtttgctgagttttctcgcctttccttccgacaagctcgaactggaaccagcgctctcccctctagacctgcctccgcgccccacccttcttcccccacacagtccctccgcagggagaattcaggtgctaaaaatgctcgggcctcgcagcttcctccctcctcctcggttcctcgaatgacccaagctgcctctttccgggcccttggaagacggtgcgaattccgcggcggcccgctctcgccagcgccacagccctgactcccacccggaggcctgagttcaaccgctttcgcttccttgcgggccgttcaaccctctgaatacgcagattcatttatttatgttttttaatgtagtaagtgggcagctaaatgaattgcaatttgtcatttttatggttaatttgaaatctcgctcttgttgcctaatcctgttagttggtggcaaaacaaggagaaacgcgtgtttcggcagcagtgattctaacaggcgttttatgttaaattacagcagaacccagaacaaaagcaggcggcggacttgcagtcccagcggcctcggccggtccgcgctgccggtgtgagccccgaaggaaagcaccccaagctggctgaccccgcgcacccccggccacacccgcccatcctggcttcgagattaagaagcccagtttggcaccccaattatgtttggcaatgtccccggtgccccagacccgcactccgctgcctcctggcttctcatgcccgcgaagcacggcctcgccctgggcgcggggcatcaccggcgcggaggcccgagggcgggtcacttcggatccctttcttcccttcctcgtctctgcctcttttcctttcttttctccctccgcctctctgtcagctcttcccgtcgtttcctcggcacccagctccagtccaggcgctgtcccagggtaggaagaagggcgatgccccttcttccccttctctggtcccctccccagcctccggctccccaaggtgcagggctccggcgggggctgggccgggcgggtgggtttctgagccgcagcgcttggagctgggggagcgggagcaggggcggcccggcgggcgggccgggacccggcttttccggctacccgtgggccaggtgcgggtttcagcacgcggggcgcgtgtgggcggaggcgccggggcccgcggctccgcttgttcgcgcgttgtcgctggcgaggcgtttcttgtccccggcgcccgctcggtgccgtctcagtgagtttgattgaaacgcggctgcgggaaggggtcgacagaggcaagctgcgagcaaggcgggggtgggggcgaggaaggggacccggagagctcccggagggcttggccggccaccgccgcgcggcgctgctcggggactgctactttgcaaggcggcggctgcccctgcggggttcgggttgcagggtcaagtgtcacgtcctccgcaatctccaatattcctgtaatgtatttaaatggacgaattcattacgcggggccgtgtgaatggggcgaggccgcgagcgcggcgcgatcagtagcgcccactaacagttcgttctgcacggcggagcgcgagaccgcggacccacggaagccccctcaatggtgtttgcgtcctcgccgccaccggcttggtagggtcctttagggaaggaggaagagttcaggcacccggacagatcctaatggtctttctgatttttctttcccttcggtccgctttccccgcgacctcctccaccctcagtccgcctttcaaacgtcgtccgcggggatggctgcgcgatggagaaattggtctcgtccagagacgcgcgcacagccgtccccgcgcacacgcgacacgcccagggccggcgtccacgtgagggcagcaccctaggtcgggtcagtcaaaccccacagcggggtttcaaacag

SEQ ID NO: 128597 - DNA, 143 bp, Homo sapiens; identical to SEQ ID NO: 96730
  misc_feature 1..143: note = chr7:155168178-155168321
  misc_feature 1..143: note = Hyper
  source 1..143: mol_type = genomic DNA

SEQ ID NO: 128598 - DNA, 85 bp, Homo sapiens; identical to SEQ ID NO: 31641
  misc_feature 1..85: note = chr7:155168529-155168614
  misc_feature 1..85: note = Hyper
  source 1..85: mol_type = genomic DNA

SEQ ID NO: 128599 - DNA, 761 bp, Homo sapiens; identical to SEQ ID NO: 96732
  misc_feature 1..761: note = chr7:155170182-155170943
  misc_feature 1..761: note = Hyper
  source 1..761: mol_type = genomic DNA

SEQ ID NO: 128600 - DNA, 1251 bp, Homo sapiens; identical to SEQ ID NO: 96733
  misc_feature 1..1251: note = chr7:155173869-155175120
  misc_feature 1..1251: note = Hyper
  source 1..1251: mol_type = genomic DNA

SEQ ID NO: 128601 - DNA, 161 bp, Homo sapiens; identical to SEQ ID NO: 96734
  misc_feature 1..161: note = chr7:155202728-155202889
  misc_feature 1..161: note = Hypo
  source 1..161: mol_type = genomic DNA

SEQ ID NO: 128602 - DNA, 35 bp, Homo sapiens; identical to SEQ ID NO: 96735
  misc_feature 1..35: note = chr7:155215884-155215919
  misc_feature 1..35: note = Hypo
  source 1..35: mol_type = genomic DNA

SEQ ID NO: 128603 - DNA, 30 bp, Homo sapiens; identical to SEQ ID NO: 96736
  misc_feature 1..30: note = chr7:155220048-155220078
  misc_feature 1..30: note = Hypo
  source 1..30: mol_type = genomic DNA

SEQ ID NO: 128604 - DNA, 3052 bp, Homo sapiens
  misc_feature 1..3052: note = chr7:155241318-155244370
  misc_feature 1..3052: note = Hyper
  source 1..3052: mol_type = genomic DNA
attctcggaggcctgcggtgggagccagggcgcggcggagagggtttcccacctcttccccagcaagcgggagggaggcgccgggctgaggctgcgctgagctcgagctcgccgcccgggtggacccgccctgttcaagcgcggaggggcggaggcctggttgggttgtagcgtggtgcggagcaggacgccgcctcgtgccatggtcactggagacgcacgcccatcttccctcccgggcccgtcgatcctgccatcttccgctcccggccgctcgtgggtgttcgtcatttagaccttccccgtgcttcatgggacgcaagccctcccccagagttcggttttgcaaaagaggtctggagccctcgctacagatcccctccctgggccacggaggatgagaagggtcaccgagccgagccgtaatcctgcgtaacccctgacctctctccttccctgcccccacggcaccccatcgtcccctccccgtctccgaggtcctccagaaaacagcgcagaattgtgcagatgtttaggagatgtgaagatgctggagatgcttaggaggcgacggttacgcgaggagaattgcttccaggtgcgcttctggaacgcacggagatcccccggcggggaaggggccggggctcgcgtcacttagtgtctgctcaccgatttccctctgaagagggggcccagggcctctgctgagggagcggggaggcggtgcgggcccctcccgggcacacatgggtgtccgctccttcctccccctcccctcccctcgcacggagagcggagagcggagagcggagagcgacagggaggcagccgaagacttgaattttgaaaggggagctggcggcgaatggtgaatgagacagctacttaggaagcgagtccagccagcccgggaggcggtggagacccacgcccggaagtaaccggattaggtctcagaatgtgatcgccccccgggtcccgggggagacgccaaggacgcgcaagcggagggcgcggagacaactgggagtcagagtctccatcacttgggctgggaacgcctctgggcgttccgacggggtggcggtgggggtcgggggaggcccttgagaaccgtgcggcccggggagagcccacccattgctgagccccgacacaggctttgaagttgctgcagtggctcagcccctcccccgtccggccctgcgcagcgcggtgccgcagagtccaggccgtgcctccgtttcgtcgctcagagcttattgcggcggctcattggaccacgtcggtggggcgatcgcagcctctgatctgtgagctgcaaagagctccgaggttcattcacaaatctgcgcccccagccgtccctccacgcacccgagccacgtcccgggacccggagagcccggggcgttgggcgctgcggaggaggcccggcttctgtcgctcccttcacctcccagcccgcgagggacttgggggaagggggagcaagctttcgctccggaagaaacgttcggaaccaaggagtctgactcctggatccgggtgcctgttggatccaggctcccactcccgggccctccggtcgaaccaagggtcccgacagggcccgaggcacccgcattcctaggagacaggagctcggccagggcgcatcaccgggtcctgctccgagccagaggatgtagtgtagacacccacccccacaccgcccctccacagagctcctctccccttggggcgtcgctgggcacagggcaggtcgctaggaatccccagtaaaaccacgctcgctcagaggttcgcggcttcctcagagggcgctggggaaagagaggggacctgatttcttcgaccctcggaggaaaagtgctcggggcctcctagggacacagccctggaagctcacctcatcttagcttaggccgcggcgaggtggggaggagagttaggagagggggagaggggctctgcgccctgcagaggcctttaattctggaggaaaaagactgggacacacccaagcgagccaaggcccgagccccacgcacctccacccacccggggcggcgcacagccagctcctgccgggcgtgagcactcgatcaagggagcaagtggaatgaaaatccagctgggggggtccccatcgacacaactgtcccgcagtcgagcttctggattcctgggagatgtggagagcctggggccggctcccgctccgcagagcagactggactgccctaggtgcctggaatgcgcctgcaccctgtccctcggacccgcgggagacccgtgttccgcaagtcccccttctcaccctagtctgcccctacctacatcccgccggcgagtgtgccaccgcgaggcgcctccttccccgggaagggagctcccttccgcgcagacccgcattgcccttcttttcgctcggttttgttttccaggggtagtttctgcagaaaggagattctcctccgggccgaagggctaccagcctgcagtcagttcagccccggaccctgggagatgctcaccactctgcggatcttgatccgaaatcctttctggccgcccactgcggagagtgtcctcgtagagaggttttcaatcgaaggagcctgggctccacattttgtcttcaagcctgagctttcagggctgctttgcacgaggtgcagatgaacttgtgtctgcaaacaagacagaaaaccctaagtgccgcccgaccttcctcttttggggaacccgcactttgtcctgggagcgtgcccagcgccttagtaccaaactttctggccggggctggcagagctcagagtcccgcttccccctaggcgcggccccctaacatctgtaacccaaatgttgcgccgcggccaaaattagccctggcagtgcgaacagagaactaaaagcaggcagtgaatgagaacagctcgcatttctccttcctggtagacggggaggtgtaaatcccgaggaattctagggcattcgctccaaacgtgggaaatcttcgcgcgtatcccgtttcttcctccca

SEQ ID NO: 128605 - DNA, 30 bp, Homo sapiens; identical to SEQ ID NO: 96742
  misc_feature 1..30: note = chr7:155244661-155244691
  misc_feature 1..30: note = Hyper
  source 1..30: mol_type = genomic DNA

SEQ ID NO: 128606 - DNA, 1836 bp, Homo sapiens
  misc_feature 1..1836: note = chr7:155246375-155248211
  misc_feature 1..1836: note = Hyper
  source 1..1836: mol_type = genomic DNA
tgggctcagcacaggcgcttctccagcgatcggggcagaaccaggacgtgcaatgcgactgcccccccctccccgctccccggcagagcttctgtccgcgccaacccacccaccaggctctgcccgcgccacgcgcgcccctggcaggcctggggcggggaaaggcgaagcgctgggcacgcgagggcctgtgcaccccagttcctacgacgctcctggcccttttcaggcccgccgctgccgcatttaaccccctccttccgggggttattctgaagaagtctcagaccctagacccagcctcccagaccccgtccccgagctcgcccggtgggcctgtaggccggtcctccttcgcccagaggagagcgcagacacgcaatgtccgcccgttggccccgcccgccccacccctgctccccgcgccccttcgtttcggcctttgtctacaggccgggtcggaacgtcagccccaggagccgacggtggctctctgctcgccccggggaaggtgttgctctcctatcggccccaattccccgcccggcgcctggggcttggctgcggggctcggctcccagccgagggcgcagggctggccaggcctgctttggctgaggtggagatctcgctctcagggattgttgggcgtctctgccccgcgagtaacgagaccgccgcgagcgaacggctttcattgagtccatttttccaagtgtcaccacgtcaagctagagaagcgaggcgagtggaggggacgcagaggggccggaaaagtcacccttctctggcctcgttttcagataaaaacgggagcctggctcggcatccgggcgcccggtgtctccggggcgcttcactgaggttttgtttgcaaaactagcgtccgtgtcctgaagcgcacggcgtctggaagctgctttcctgctcgccctctccgaggcccctctttgtgcagcgagcctgagaaatatggaggaccgtcctccgcaagcgggtggtcgcgggcgctctccgattcctgggtgaagctagagggaaaacggggttcccgggtcagtgccccactttccatcccgggagaaactaatgtccggagagggctcgtctgatccgcacagaaaggccgaccttgagggcggcggtcgttcgggggagaaagcggaggctctgggctcgcgggagcgcggcagccggggctggcatcgcagaggagagacacgccactgccccgcatccccagaaagcgcgaggcgccgtcccagctggggcaggcggccgaggccggtcctcatgcgcgcttctcgaagcttcctgaaacaccttgcggagttccgtgtgtatagaactcagcaccgcccagcccctgggcagctcaactttctgcagccccatcccagcttccccggccctttgaacggtgacccctcttaccgctttcccagagttgtttcgtgtttgggtccactctggggggcccggtaccctctagttatctctctcttcatttatttctctttctcctattcctccctccacctctcaccttcctcctttccaggagagcgacccacgaattcctcttcctccagccaaccccagggcccagcccgcagaccctgcgagggcaggtctctgcccaccggcccgccaggcgccctggaggtgacgctctgcttcccagagtctctgttgcagccacgaattggggtctgggtcgcaggaaagcacagggctgaagcccagcgtcttggggccatttatactgaggcagtcagaggcaaagagtcccaagaattcagaaaatacttctcaggaagccgcctaattggcttt

SEQ ID NO: 128607 - DNA, 4514 bp, Homo sapiens
  misc_feature 1..4514: note = chr7:155248614-155253128
  misc_feature 1..4514: note = Hyper
  source 1..4514: mol_type = genomic DNA
ctctgaccagagccacgtccagtggccaggaggccagcccagcacctcctcccccaccattcccgtcctgggtgggggggtaattttcctgggagcagctgtgggaactgtcgtttctcatcccagcccagccagcactctgaagcctgcaggggaaggacagcacgtgggatggacactggggaaggagcttcgcaaggccagggtgcaaccttcaggccccaggtggcctggcaggccacgctgcctcggagatgcttgccagactccccaagttcactcagggcctggcagcaacctgctggctgcctctgcgggggtctgggttgctgagcacggtgcagctgcccagggccaatcagccctagggtgtccgtgccaggctgcggcctccccgcctcccccgcactgagggtactcatggcgtgcaaatgctcccgcacccccagagctgccctatcggatgtttccaggaattcacacatttccataaaaatgcattttaaatgatggacaggcgagcctggggtaacaacgggtgtttggtgggtagacaagagcaaatgggaaggagcccgagggaggagggggaagagaagaggaaacagaacttccagttggacattctgacaacagctggaaggaaagtctagaaaagatgaagagagaggaggggagaaaccaactggggctcccacccttgccgttggattcctaattctcgtttcaaatgggccctgctctccggcaaaattagtttaaaggattttaaaacaaagaaaacgagatgaccggtctgggagctcctcaatcagagtagagaagttagaggggggcgggcgacttggttttgaagtcttagctgaacagtcacccctcctctccttggcaaaaaggattcctttagaacctccgaggctcctggatttctcccttcgcaaatggagccgcatactgcattcccccgctctttcggatcgctaagcatgtttcatgagggtcgctgtccccgggtggaatgcggccgtatgcacgcgcctccctgcacacgcacacacacgcacacttacaataagtgtctgcaggaggagtgtcctgcgcgccagctctgcgtttaagacaggaagctgccgggttaccgagtcaaatgggagtgacactattcctctccatcagcaaggaaagcggaccacaaaagtccctttgtatctcggcagctcatttaatattatttatgcattttgtgcaaggaattgtgggatttcgccccacggtaaacaatatggaaatcttaaaaatagcgatcttcctgtgcgtgtccacctacgcgccccggggtgacctggcggggctgtcgccgggtgactcacacccctgaaccgcgaagcgacagggaaagcgcgggcgagcgcaggagacgcggtcgggggtctctccgggttcctgggctcccgcacccggagcgggggacgcggccgctttaaggggaggaggggcggcgggctgctcctgtcacccagcggcggccggagcgtcacgtgggcgcgcggcgccgcggccattggcccgaggcacgtgtccaggagaccggcctgcgacgtcactcgagggggctctgttaaaaataagaacaaaaatccagagtgaaagtgtctcaggttgcgccgagtggcctggaaatttccgagcccgcgcggaggccgaggcggcgagggcggcggacggccggggagcgcgggcggcccagcccggcccggccgggccctggcctcgcgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccggctgcgcggcgaagtcgaggacttggctctgttgaatctctcatcgtctgggcgagcggggcggctcgtggtgtttctaacccagttcgtggattcaaaggtggctccgcgccgagcgcggccggcgacttgtaggacctcagccctggccgcggccgccgcgcacgccctcggaagactcggcggggtgggggcgcgggggtctccgtgtgcgccgcgggagggccgaaggctgatttggaagggcgtccccggagaaccagtgtgggatttactgtgaacagcatggaggagaatgaccccaagcctggcgaagcagcggcggcggtggagggacagcggcagccggaatccagccccggcggcggctcgggcggcggcggcggtagcagcccgggcgaagcggacaccgggcgccggcgggctctgatgctgcccgcggtcctgcaggcgcccggcaaccaccagcacccgcaccgcatcaccaacttcttcatcgacaacatcctgcggcccgagttcggccggcgaaaggacgcggggacctgctgtgcgggcgcgggaggaggaaggggcggcggagccggcggcgaaggcggcgcgagcggtgcggagggaggcggcggcgcgggcggctcggagcagctcttgggctcgggctcccgagagccccggcagaacccgccatgtgcgcccggcgcgggcgggccgctcccagccgccggcagcgactctccgggtgacggggaaggcggctccaagacgctctcgctgcacggtggcgccaagaaaggcggcgaccccggcggccccctggacgggtcgctcaaggcccgcggcttgggcggcggcgacctgtcggtgagctcggactcggacagctcgcaagccggcgccaacctgggcgcgcagcccatgctctggccggcgtgggtctactgtacgcgctactcggaccggccttcttcaggtgagcccgcggggaccacgcgtcccggctcgccgcggggaggcccgcggagctggggggcggtgctggcgcgggaacttaccgggaggaaaacatctcgaacctcccccgcgcacacgcacaaagactcacgcgacattgtgtgaagctgacgccggcccgggcagcggccaggagtccagcggcaggactgattcgctagggggtacagacttcttaggaccgcagaagggaccttctttctttctctgtctctctctctccttcctctctccctgtctcccctctctgtcttccaccccgccttggcgcatctcttcccagcccctagcccatgtctcccccactgtagttttttttggtgggaacgtggtggctggaagatgggcccggaagtgcacactctcatccccttccctacgatcttccaactcaggccaggccggggacgcatgccccagcccaccccagacttgtcctaccatccggttatcccggctgtgctcggggaagaaaaggcgaggccctttgccgctctgccttctgcccctcgggcctgcgctgaccggtgggactcaggaggatgcacacagggaaggaggaaaataaaggcgccctttccccttggctccactttgtttgccagcgccagcccgcagtggtggggctcagcccccttcctgcacacagcgaggacaagggaggcagccgtccctcccggcacctgccatccccaaatagaaaggaccttctctcagggtttcctgggggctgctgatgggaaagaggcagcattcgcaggggccctgcagagatgctggatatattttttcatagatctgcgattttaaaaaactaagtccatgtccttgtagaaatcatcaactgcattccatgcgggtctgcggctgggaaccgccattagaagtggactgtttgaccccgagctggcagcggatccccgctgcccccaaaccctcaactattttgcgggggtcatttgcccagatcacagcaggagtgagccaacccttgggccgccatcccgcagaactatgcgtgcatatttctgatgaaattcagatttctcagctagatctgaaatttgctccattgttctcgtcttcctcctttgttaatatttaattaacatacaggctcacaatgccgggcgaggagactcggccgggctttgtgcggcgcgggagttcgctgagccagcccccaacggcccgggagctgggcagcaccgcccggcccggcctggcccggcccagctcagcccagcccaagtcgcctatcttcatgggctttaaaatatccctgcaagataatgtttctgttctttggtttctccgaaagaaaggggag

SEQ ID NO: 128608 - DNA, 551 bp, Homo sapiens; identical to SEQ ID NO: 96752
  misc_feature 1..551: note = chr7:155254848-155255399
  misc_feature 1..551: note = Hyper
  source 1..551: mol_type = genomic DNA

SEQ ID NO: 128609 - DNA, 201 bp, Homo sapiens
  misc_feature 1..201: note = chr7:155256218-155256419
  misc_feature 1..201: note = Hyper
  source 1..201: mol_type = genomic DNA
caccaagggcccaaccgtgtgcatacatcgtctgcgtctgtggtctgtgtcgctgtccccagtcccaccgcagtcctgccgcaggcctaaccctcctgccctgggcactgcctccatgcagaagcgcttcgaggttctggggctaaaggcctggggtgtgtggcctaaagcccaagagcggtggggcgaccctccttttgg

SEQ ID NO: 128610 - DNA, 108 bp, Homo sapiens; identical to SEQ ID NO: 96755
  misc_feature 1..108: note = chr7:155257081-155257189
  misc_feature 1..108: note = Hyper
  source 1..108: mol_type = genomic DNA

SEQ ID NO: 128611 - DNA, 3521 bp, Homo sapiens
  misc_feature 1..3521: note = chr7:155257856-155261377
  misc_feature 1..3521: note = Hyper
  source 1..3521: mol_type = genomic DNA
ccacccgtgctggaccgaggcgctttcccctggggacaggaactttttactccactgagacaaagagactctccttttcaaagtgtcatttttgtttaccttttgttgtttcccccccaaaacaaaagactttgtacaacttcctaagcaggattgggggagggatcagcttcgcctgtgctgaccgcgcctctggattccgctcatcaggaagtgtttggggtctttgagcgagtgatctacgcgttgaattgctgtttttccaaactttcatggcttaaaaattttttttcttctccctgtaaaagaaactcagagactggtgatctgttaccgaagacgactttttaggcgttttctgtttccccaggcagctgggccgttggcgttcccaggcggaagcggggcctctgggctgggcctctgccctgccaggaagcggtctgggggctgcccctcgggattttcagaaccctggaaggagagagctggggtctcaccgcggagactcccgagttctcgttgcctgggcccgagctgcgccccagggtcatcgctgatggcgcgagaccacgcattccccgcgaaccccgacttctgaacagttcagaaagttcgtagattaaaaaccaaacaaaaaatactggcacaacttctattgccgtattggcctctctcttattttaataaaaatacggtaacatgaagcgatcatttttttaaaaatctgttttcaaagtataacactgaaaaggggcaaggcacagctttgtaaggtaatgagttccccgtcctcagaggtgttcaagcagacgctaggcttacagtggcatggagagtgttctttctctttggaactggatgagtcctcagacccttgaaacgctgagtttttttttttttttttactcctatgtttattacattttaatccaacagcatataatctaagctgctccctcatggagagccgcggctgtgccacctgcctgctttcgccatggagaccggagtcaggcctgcagggaagtcggtgcgcctttcccaagtcctctgcccgctggttcctctcgggcctcccgggctctgcgtgccgcggatctggacccggactgcagacaccgccccacgactgggcccccggccagactgttaccccacaggaggagggttccctaagtgtgcagaagaggaaagctcatttataaagtccttgctccttcgagctgaacgacccccgcgcccgaggcctagctgtgtccccgccgggcccaggctgagcttactccacactgctccatagccgggcagagactccgcgagggtctgggagtcctggcctcggaggacccgccgccctgcaggcctgcccaagcaggcgcccccgcgagagtgcgggacagagagggcctggcggggctccttggcgctgagagccctccttctccgctgcacccagctctgccaacggggctggatgagtgggggctggagtcagaatcccagggtctacacccgccgacagcagcaatgccgacccgccctgcctttctcctaaggagcggagggaaggagccatgtgaatgaccccagcctgaccaccaagagggcgccagcatttctgttttcctagagtgaaaaggtcaaatcgatgggggctcctacaccgctggacacaggtgcgcccgggcgtccagtgcgcgcaacacacgcccagacactctatatgcaaatatgcctgccgccgcggagccggccgggaggcagcgtttgttcgctggggttctgctagaagtcattctgtctcccgctggtttaatatccgccctctgcggtctccgctcgcctcggcggctcccgaagcgcccccgggagggtcccggctccgccgaaaactgcagcctgccaggctgagccgccgcgcgctgggaggttaatagcgactgacgacaaagggccaaggtgcaattcctaaagcggggattcgccgggtgaggcagaaatcagcctccggggagatgggtccccccttcccgacgcgcccctgcacacactgctgccccggcgccgggcctccgggcggggacccctcttccgggcatcgcggccccattcggcggagagctaggccctctccaggcctccaagtagggagcggacgtgggtggtggggaagggaagccgccggcgggacggagagtggggtcccccggaccctgggtcgggcaggcctggcgctggcagctctgttgcacagatttgtgagcgatgctggtggccgcattgccgcgcggcgcgaaccccaagtagaccattcatgtttttattaataatctcaaacacttcattatatttatgctgcctgcccagagaaaataaaaggccattcttgaaatcgcctgaaatgtaataatattcattaaagcgcctcctaattatgtgatttaatcaagcgtggtgcgcccgcgctctcggctctcgctggaaaggctggcgatgacggttattattactgctgttgttagtggcctcgtgatagcagccggccagctcttcagtccaggcccagtttcctcagagagactcggggagccccactttgagggatggggttccccggaacgactccgaagtcccggagaccaggcgcggcccaggccctctgcccttctccagccccagccccagccccagccccagccccgggcaaactcttccaggccgagggcaggactttctccagacccttggggccctctgtgtcccctggggacgcccgacccggctttctaggagggggaactccgggtcctgagcccgggccccgccccgttggctgttccgccccctccagggctgagccccgcgcaatgcccgaagcagaaacaaagagtcgccgagatctgcctcctgggccgccttttcaccccctcagcctggaaggcgtcccagagaggccccacccccagcctccacggagacccaggagggaagaagagccgggacccggtagccctgaggggctgccgggcctgcggcgctttctccgccgcagaggggttgggtgggagacgcaggcgggaaggaccctgtcccagccgagagtcctctgtggggtcgaggaatggtgaggatcactgtttgcaccaaccgtctggaagaaaccgggcggccagccgctcgaccccatctgtcgagatgtgaaacttggccgcgcggtccgggcgcgcgctgcctgcgcggaaggagccgcctccctcctttcagcgaacgcattcggggttcccccctcccgccaagtcctttgtctggaaggggactggcaggctctgtcgtcgccgtgtgcccccctcctttccccagcctctaccccctccaactaactttcctttcttcccttctcttttcttccctctctggatgggtaatcacaggctccgctgccaagcgcgctgcgaggagccgctgcccgttcccgtcggtgcccctccccgcggcagcctggccgagtccgcccagcc

SEQ ID NO: 128612 - DNA, 238 bp, Homo sapiens; identical to SEQ ID NO: 96763
  misc_feature 1..238: note = chr7:155262357-155262595
  misc_feature 1..238: note = Hyper
  source 1..238: mol_type = genomic DNA

SEQ ID NO: 128613 - DNA, 277 bp, Homo sapiens; identical to SEQ ID NO: 96764
  misc_feature 1..277: note = chr7:155264079-155264356
  misc_feature 1..277: note = Hyper
  source 1..277: mol_type = genomic DNA

SEQ ID NO: 128614 - DNA, 30 bp, Homo sapiens; identical to SEQ ID NO: 96765
  misc_feature 1..30: note = chr7:155275898-155275928
  misc_feature 1..30: note = Hyper
  source 1..30: mol_type = genomic DNA

SEQ ID NO: 128615 - DNA, 139 bp, Homo sapiens; identical to SEQ ID NO: 96766
  misc_feature 1..139: note = chr7:155283645-155283784
  misc_feature 1..139: note = Hyper
  source 1..139: mol_type = genomic DNA

SEQ ID NO: 128616 - DNA, 24 bp, Homo sapiens
  misc_feature 1..24: note = chr7:155300117-155300141
  misc_feature 1..24: note = Hyper
  source 1..24: mol_type = genomic DNA
aaatggacctcctatcgaaggagc

SEQ ID NO: 128617 - DNA, 24 bp, Homo sapiens
  misc_feature 1..24: note = chr7:155300201-155300225
  misc_feature 1..24: note = Hyper
  source 1..24: mol_type = genomic DNA
acagctccccgaaatgattaaacc

SEQ ID NO: 128618 - DNA, 30 bp, Homo sapiens; identical to SEQ ID NO: 96769
  misc_feature 1..30: note = chr7:155301399-155301429
  misc_feature 1..30: note = Hyper
  source 1..30: mol_type = genomic DNA

SEQ ID NO: 128619 - DNA, 295 bp, Homo sapiens; identical to SEQ ID NO: 96770
  misc_feature 1..295: note = chr7:155301710-155302005
  misc_feature 1..295: note = Hyper
  source 1..295: mol_type = genomic DNA

SEQ ID NO: 128620 - DNA, 1055 bp, Homo sapiens
  misc_feature 1..1055: note = chr7:155302308-155303363
  misc_feature 1..1055: note = Hyper
  source 1..1055: mol_type = genomic DNA
aagtctggccctccccggggctgcccttggctgcgcgtcccccacgctgcagccgcgcgatggcccgggctggggtggacgtggggctgggagaggaaggggctcacggacgggcgccccatctcccaggcgggctcctcggctgctttctttgggaacagctggtgcacgtccccgcgcgcccctctccctccggaattcggcgaggattcagctggaccctttggccaccacctccgccccgggcgcgggtcaaagagcacccctcgcccttggtaacggagacaaaacgttcggggccgtctagacaggtcaaggtgcaggatgcggcgtccccgcggctccttccggaagggggcgtggagccgccaagggcgccggaccgcgccgcagcccgggcctttgcgggctttttccctctccaccctctgctgatcaaagtaggaagtttgcatgacaaccgcagtgaaaggggctgaatcacaaatgaactcgatttctgcagtgttgatctatccagcctccattgtcccctttcaggcgcagtatgaacccttccggtgccagcggccgcgctacattcacaggcgcgctcggggcgcacaaagggtctccgcgcttcaccgccatctggccacaaatctcatcagcggcgcggcggcgtccccttgaaagcgcgggcggagggtgcgcttgtgttcttgagacccaggttccattacaaaccacccagcatcgccaccggcgccccccgtttcaataaggaagccactttgtcaaaacattctaaaagaaacttgggaagaggacgcgtcagagaaataccgccgccgattaactatcagctgcgcctcccctgtgcacaggtaacatccctccttctcccccacgactcggctggagcttgattttgagctgctctcaaggcccaggcactcgaatcggaagttaaatagcttatggactatttaatagaatataccaccacacgtatctaatcactcaaataccacgcttttaaaactcatgaatgttttaatcgctaaaaatgtcta

SEQ ID NO: 128621 - DNA, 30 bp, Homo sapiens; identical to SEQ ID NO: 96773
  misc_feature 1..30: note = chr7:155309803-155309833
  misc_feature 1..30: note = Hypo
  source 1..30: mol_type = genomic DNA

SEQ ID NO: 128622 - DNA, 30 bp, Homo sapiens; identical to SEQ ID NO: 96774
  misc_feature 1..30: note = chr7:155314707-155314737
  misc_feature 1..30: note = Hypo
  source 1..30: mol_type = genomic DNA

SEQ ID NO: 128623 - DNA, 745 bp, Homo sapiens; identical to SEQ ID NO: 31679
  misc_feature 1..745: note = chr7:155325796-155326541
  misc_feature 1..745: note = Hyper
  source 1..745: mol_type = genomic DNA

SEQ ID NO: 128624 - DNA, 67 bp, Homo sapiens; identical to SEQ ID NO: 96776
  misc_feature 1..67: note = chr7:155326787-155326854
  misc_feature 1..67: note = Hyper
  source 1..67: mol_type = genomic DNA

SEQ ID NO: 128625 - DNA, 229 bp, Homo sapiens; identical to SEQ ID NO: 96777
  misc_feature 1..229: note = chr7:155363288-155363517
  misc_feature 1..229: note = Hypo
  source 1..229: mol_type = genomic DNA

SEQ ID NO: 128626 - DNA, 103 bp, Homo sapiens; identical to SEQ ID NO: 96778
  misc_feature 1..103: note = chr7:155436120-155436223
  misc_feature 1..103: note = Hypo
  source 1..103: mol_type = genomic DNA

SEQ ID NO: 128627 - DNA, 497 bp, Homo sapiens
  misc_feature 1..497: note = chr7:155579858-155580355
  misc_feature 1..497: note = Hyper
  source 1..497: mol_type = genomic DNA
ttgttttttgcggaacgtatgtcgtcaggcggtccttctgtccctgccccaaggtaagccccgaggcgtcccgggcctgcgcccccagcgtccccgcaccagcgccgcgcgacctgccgctggctgcgtccgagcaaggggtccgggcccgcctggctgccccgagggtcccaggaggcagcgcagggacagcccccgcctgagcccgcggctaaaggaggccgggccgccgcgcacccccgcaccccttccccggaccgcgaggctccgcgcgcgcatctctgccgggagctcccgaccacggcccagcgcaagggacctccgggccgcccctgtctcgggccctgccgcgccgcccgcccgctgcaggccaggactgcgctctgtctgcccacggcccccgcctggcacacacgctggggacctttcctcagtgctgcctcgacatccgaaggggctgggacgcccgtccctggtgggagcgagcaccggggcgg

SEQ ID NO: 128628 - DNA, 156 bp, Homo sapiens; identical to SEQ ID NO: 96781
  misc_feature 1..156: note = chr7:155580726-155580882
  misc_feature 1..156: note = Hypo
  source 1..156: mol_type = genomic DNA

SEQ ID NO: 128629 - DNA, 635 bp, Homo sapiens; identical to SEQ ID NO: 96782
  misc_feature 1..635: note = chr7:155581242-155581877
  misc_feature 1..635: note = Hypo
  source 1..635: mol_type = genomic DNA

SEQ ID NO: 128630 - DNA, 151 bp, Homo sapiens; identical to SEQ ID NO: 96783
  misc_feature 1..151: note = chr7:155582218-155582369
  misc_feature 1..151: note = Hypo
  source 1..151: mol_type = genomic DNA

SEQ ID NO: 128631 - DNA, 156 bp, Homo sapiens; identical to SEQ ID NO: 31682
  misc_feature 1..156: note = chr7:155600567-155600723
  misc_feature 1..156: note = Hyper
  source 1..156: mol_type = genomic DNA

SEQ ID NO: 128632 - DNA, 390 bp, Homo sapiens; identical to SEQ ID NO: 96785
  misc_feature 1..390: note = chr7:155601020-155601410
  misc_feature 1..390: note = Hyper
  source 1..390: mol_type = genomic DNA

SEQ ID NO: 128633 - DNA, 263 bp, Homo sapiens; identical to SEQ ID NO: 96786
  misc_feature 1..263: note = chr7:155601688-155601951
  misc_feature 1..263: note = Hyper
  source 1..263: mol_type = genomic DNA

SEQ ID NO: 128634 - DNA, 325 bp, Homo sapiens; identical to SEQ ID NO: 31685
  misc_feature 1..325: note = chr7:155602802-155603127
  misc_feature 1..325: note = Hyper
  source 1..325: mol_type = genomic DNA

SEQ ID NO: 128635 - DNA, 98 bp, Homo sapiens; identical to SEQ ID NO: 96788
  misc_feature 1..98: note = chr7:155604921-155605019
  misc_feature 1..98: note = Hyper
  source 1..98: mol_type = genomic DNA

SEQ ID NO: 128636 - DNA, 43 bp, Homo sapiens; identical to SEQ ID NO: 96789
  misc_feature 1..43: note = chr7:155605334-155605377
  misc_feature 1..43: note = Hyper
  source 1..43: mol_type = genomic DNA

SEQ ID NO: 128637 - DNA, 35 bp, Homo sapiens; identical to SEQ ID NO: 96790
  misc_feature 1..35: note = chr7:155623718-155623753
  misc_feature 1..35: note = Hypo
  source 1..35: mol_type = genomic DNA

SEQ ID NO: 128638 - DNA, 30 bp, Homo sapiens; identical to SEQ ID NO: 96791
  misc_feature 1..30: note = chr7:155674904-155674934
  misc_feature 1..30: note = Hypo
  source 1..30: mol_type = genomic DNA

SEQ ID NO: 128639 - DNA, 50 bp, Homo sapiens; identical to SEQ ID NO: 96792
  misc_feature 1..50: note = chr7:155683057-155683107
  misc_feature 1..50: note = Hypo
  source 1..50: mol_type = genomic DNA

SEQ ID NO: 128640 - DNA, 85 bp, Homo sapiens; identical to SEQ ID NO: 96793
  misc_feature 1..85: note = chr7:155752508-155752593
  misc_feature 1..85: note = Hypo
  source 1..85: mol_type = genomic DNA

SEQ ID NO: 128641 - DNA, 105 bp, Homo sapiens; identical to SEQ ID NO: 41547
  misc_feature 1..105: note = chr7:155753582-155753687
  misc_feature 1..105: note = Hypo
  source 1..105: mol_type = genomic DNA

SEQ ID NO: 128642 - DNA, 34 bp, Homo sapiens; identical to SEQ ID NO: 41548
  misc_feature 1..34: note = chr7:155786790-155786824
  misc_feature 1..34: note = Hypo
  source 1..34: mol_type = genomic DNA

SEQ ID NO: 128643 - DNA, 35 bp, Homo sapiens; identical to SEQ ID NO: 96796
  misc_feature 1..35: note = chr7:155792417-155792452
  misc_feature 1..35: note = Hypo
  source 1..35: mol_type = genomic DNA

SEQ ID NO: 128644 - DNA, 30 bp, Homo sapiens; identical to SEQ ID NO: 96798
  misc_feature 1..30: note = chr7:155838899-155838929
  misc_feature 1..30: note = Hypo
  source 1..30: mol_type = genomic DNA

SEQ ID NO: 128645 - DNA, 344 bp, Homo sapiens; identical to SEQ ID NO: 96799
  misc_feature 1..344: note = chr7:155854210-155854554
  misc_feature 1..344: note = Hypo
  source 1..344: mol_type = genomic DNA

SEQ ID NO: 128646 - DNA, 215 bp, Homo sapiens; identical to SEQ ID NO: 96800
  misc_feature 1..215: note = chr7:155871902-155872117
  misc_feature 1..215: note = Hypo
  source 1..215: mol_type = genomic DNA

SEQ ID NO: 128647 - DNA, 141 bp, Homo sapiens; identical to SEQ ID NO: 96801
  misc_feature 1..141: note = chr7:155898166-155898307
  misc_feature 1..141: note = Hypo
  source 1..141: mol_type = genomic DNA

SEQ ID NO: 128648 - DNA, 326 bp, Homo sapiens; identical to SEQ ID NO: 96802
  misc_feature 1..326: note = chr7:155898826-155899152
  misc_feature 1..326: note = Hypo
  source 1..326: mol_type = genomic DNA

SEQ ID NO: 128649 - DNA, 30 bp, Homo sapiens; identical to SEQ ID NO: 96803
  misc_feature 1..30: note = chr7:155917143-155917173
  misc_feature 1..30: note = Hypo
  source 1..30: mol_type = genomic DNA

SEQ ID NO: 128650 - DNA, 34 bp, Homo sapiens; identical to SEQ ID NO: 96804
  misc_feature 1..34: note = chr7:155919137-155919171
  misc_feature 1..34: note = Hypo
  source 1..34: mol_type = genomic DNA

SEQ ID NO: 128651 - DNA, 204 bp, Homo sapiens; identical to SEQ ID NO: 96805
  misc_feature 1..204: note = chr7:155920367-155920571
  misc_feature 1..204: note = Hypo
  source 1..204: mol_type = genomic DNA

SEQ ID NO: 128652 - DNA, 38 bp, Homo sapiens; identical to SEQ ID NO: 41553
  misc_feature 1..38: note = chr7:156012968-156013006
  misc_feature 1..38: note = Hypo
  source 1..38: mol_type = genomic DNA

SEQ ID NO: 128653 - DNA, 266 bp, Homo sapiens; identical to SEQ ID NO: 96807
  misc_feature 1..266: note = chr7:156025663-156025929
  misc_feature 1..266: note = Hypo
  source 1..266: mol_type = genomic DNA

SEQ ID NO: 128654 - DNA, 30 bp, Homo sapiens; identical to SEQ ID NO: 96808
  misc_feature 1..30: note = chr7:156124519-156124549
  misc_feature 1..30: note = Hypo
  source 1..30: mol_type = genomic DNA

SEQ ID NO: 128655 - DNA, 50 bp, Homo sapiens; identical to SEQ ID NO: 96809
  misc_feature 1..50: note = chr7:156138347-156138397
  misc_feature 1..50: note = Hypo
  source 1..50: mol_type = genomic DNA

SEQ ID NO: 128656 - DNA, 197 bp, Homo sapiens; identical to SEQ ID NO: 96810
  misc_feature 1..197: note = chr7:156177617-156177814
  misc_feature 1..197: note = Hypo
  source 1..197: mol_type = genomic DNA

SEQ ID NO: 128657 - DNA, 33 bp, Homo sapiens
  misc_feature 1..33: note = chr7:156189973-156190006
  misc_feature 1..33: note = Hypo
  source 1..33: mol_type = genomic DNA
tctttccagggcatgcgacgtgatcattttcac

SEQ ID NO: 128658 - DNA, 30 bp, Homo sapiens; identical to SEQ ID NO: 96811
  misc_feature 1..30: note = chr7:156240296-156240326
  misc_feature 1..30: note = Hypo
  source 1..30: mol_type = genomic DNA

SEQ ID NO: 128659 - DNA, 30 bp, Homo sapiens; identical to SEQ ID NO: 96812
  misc_feature 1..30: note = chr7:156290677-156290707
  misc_feature 1..30: note = Hypo
  source 1..30: mol_type = genomic DNA

SEQ ID NO: 128660 - DNA, 30 bp, Homo sapiens; identical to SEQ ID NO: 96813
  misc_feature 1..30: note = chr7:156397201-156397231
  misc_feature 1..30: note = Hypo
  source 1..30: mol_type = genomic DNA

SEQ ID NO: 128661 - DNA, 525 bp, Homo sapiens
  misc_feature 1..525: note = chr7:156409310-156409835
  misc_feature 1..525: note = Hyper
  source 1..525: mol_type = genomic DNA
ctgcagaaaagtcaccgtcacacgcagagtccaaaactcccctttccccgctggaaccactttctccaaggagctccgccccgcgctctccccgaccccgtgcgcccccagacctcgcgtcccccgcgctctcccccgccgcgccctcctgccccgcgcccctcctcgccccgaccccgcgcccctgcgcccgggctccagcccggtccctgccgcctcccgcgccccgcgccccgctcctgcccgcggcccgtcccctccctgcagcgcagcgctctgggttcgggtctctgccctctccacccgcctttcccgcgagtcttcttggcttccgtgtccccctccccagccgggcgtcacccccgcaccccgcatctgcgcccccctcccgctaacccgcggcctccgcaagggcagcgcgctcagccgggtgaacctggaactgtgttcctggcccagcgctttcataaaagggcgcggaatagtaagtcctagttcaaggaataaacacggatccccactggc

SEQ ID NO: 128662 - DNA, 257 bp, Homo sapiens; identical to SEQ ID NO: 96816
  misc_feature 1..257: note = chr7:156432918-156433175
  misc_feature 1..257: note = Hyper
  source 1..257: mol_type = genomic DNA

SEQ ID NO: 128663 - DNA, 30 bp, Homo sapiens; identical to SEQ ID NO: 96817
  misc_feature 1..30: note = chr7:156507056-156507086
  misc_feature 1..30: note = Hypo
  source 1..30: mol_type = genomic DNA

SEQ ID NO: 128664 - DNA, 178 bp, Homo sapiens
  misc_feature 1..178: note = chr7:156701741-156701919
  misc_feature 1..178: note = Hyper
  source 1..178: mol_type = genomic DNA
gcaatgcggcctgagcgccagcggggctagggggcgctgaggccacacggaacgccggcgactcactgcgccaggccgggccaccgtgcagaacgcgcgcggatctcacaccccaccatgcggaacgcgcgcgggtcacacaccgcaccgtacggaacacaggcggatcatgattcgt

SEQ ID NO: 128665 - DNA, 105 bp, Homo sapiens; identical to SEQ ID NO: 41557
  misc_feature 1..105: note = chr7:156744694-156744799
  misc_feature 1..105: note = Hypo
  source 1..105: mol_type = genomic DNA

SEQ ID NO: 128666 - DNA, 30 bp, Homo sapiens; identical to SEQ ID NO: 96820
  misc_feature 1..30: note = chr7:156778228-156778258
  misc_feature 1..30: note = Hypo
  source 1..30: mol_type = genomic DNA

SEQ ID NO: 128667 - DNA, 87 bp, Homo sapiens; identical to SEQ ID NO: 31690
  misc_feature 1..87: note = chr7:156794072-156794159
  misc_feature 1..87: note = Hyper
  source 1..87: mol_type = genomic DNA

SEQ ID NO: 128668 - DNA, 26 bp, Homo sapiens
  misc_feature 1..26: note = chr7:156794459-156794485
  misc_feature 1..26: note = Hyper
  source 1..26: mol_type = genomic DNA
gtaagccactgcgcccagcctgattt

SEQ ID NO: 128669 - DNA, 1106 bp, Homo sapiens
  misc_feature 1..1106: note = chr7:156794998-156796104
  misc_feature 1..1106: note = Hyper
  source 1..1106: mol_type = genomic DNA
cacctcctctcccttcgagctgtttctttactccctgacaccagggattaaccggggtctcctggctgcctctcacctggcagccggagctccaggaggggctggaaaggagccccctgggcctccgtctggggggcgtgtgtgaactgttttctcccgtcacaaaaaaggcttcctccacatgcgtttgcacgcccggcagaattcgcccacagcaaggcccccctttctaagaagggaggagaacccacattggagcaaagaaaacggtggccaagaggtgggggcctcggtagggcaaggaggcaaggctgggttccaggggacagggtcagctttgggtggggcccagagccccgggtcgcagtgacggccgccgcaggggtctccccccgcgtaccttcgcttctgttgaaggcagtgagatccgcaggcctccgggacagctagaggacagcagacatgtcccgtgggggaagcctgggcctgtctgaaaacaccgcctcagctccctccggggtccccctgcgtagacctggcttcaggtccggagaaccggattcttgagggctgcaaagactttctcccccatgcgcggggtcagctggcggctcaggtgcgattggaggcctgggccccgagggaccaccgccccaggccgagccgagtcagcgaccccgagcgcggcgcccaggggtgggggtcgcgcccgcaaggcgggcagagccgggcctcgagaccgttcattaggcagaatgaattgttcaccgtgcccggagtggatgaggacgagccagtgattatatttaaatttgctataattgatttggggaagagctactgtgacaagaacgaattgatcattaaatttattagcgagataaattccgcggcgactgagcggcctgctggaggcgcaggggccggcgcaggtccggggcctggctctgctggaggacgggggaggggcggccctattaacagcgtcttcctttgatgtcgctcttccccgcgtcccagaggaagcgcctgtcccctgggggtagagggacagaccctccgcggaggcctggggcaccccagctccaggccgagcccccactctt

SEQ ID NO: 128670 - DNA, 3016 bp, Homo sapiens
  misc_feature 1..3016: note = chr7:156796494-156799510
  misc_feature 1..3016: note = Hyper
  source 1..3016: mol_type = genomic DNA
tttatggaaggggcccggggtgataatgagttgccagagaggatattaatctccccgcgccctgaggcagaggagtggctgcgctcgccccgcggtaatcacccaaatgaaacgccaggcccttctgaactcattttatccgctgggaggaggggaggggaggagggaggagaagggcacacgcaggtgctgctgagaaagtgacaaacagaaggaaggaggaaggcccgggagaagggataggagcggcgtccccgtcgcccgtctcctccggggccaggagaggccactgggtcatcgatgggggaagggggccgggagtcgcgccgggctgggtgggccgcgggcctgcgctcctgggcggacgagagcgcgggctgagcccgcatgtgtgcagcacatggcgctgggcctggctgcggtgattgatggcgcgcgctgcagaggctgattaacccggagccgctgcagccgcggtgtggagcgctgctgcagtccgccgctgtcctcgcggacttgtttgcacagagccaagaagaccgatcctggccagccaaggaaggttctgctaacagagagggccggggtcgaggagagagagaagcaccgcgcaattcggtgcgttccgggaaatgtgcctcagtagcgcctgaggtcacagggaccccacatgctactaacgcctagtcgttttaagcttattttctgaaacgtccaaatagcgtatttccacttctggagtgccaacgaagcaacagctagcaaggaaataggaaaataaatagagtccacagctccgcttccgagggacacgtgtcccgggacaggtgtgcaccaggcagccgggcatgcgctgacacctggccacaggtatttttgccaacacttcacattgcgactccccagtagcaggcgcggaggtggtcctgacacccacttgagactccgattttcaccctcagctgccaaccgccgagtagacaccctccccatcatttctacaagcaaattgtaatgccgcgggcataatcccccaaaactcgtgcacgctgatccagtacaaaaccaatttattttacattccatcgtgggcgatgggagaagctaaataataatttagcatgcatacgtagacgtttctttttatatataaatacaatatacaaaaataaagacagtacagttttgagatttccagcagtttgaacgctcgtgacataatccccccgaccccagagacgtaagcataaacccttttttctttttccaaatactctgcagaatggcggctccagaggcggtttcaagtttcataagtcaggtaacactgtgggtttccgccttctcggacgcggggaaaggggagacaggaggcttccccttgcgcggggtgggtcggttcttctcacacgcactcgcgcctcccccaacaccaaccaaaattaattttaaaagaaccagagttcaagtttcagccccctgggtctccctctcgctgtttcttgaagagcaggtgaggcgcccttgcttaaaagggaagcgcccaggaccggagccgcggccgaatccctccagccccggcctgggcgaggggtccatggggcggcggtcgagcctgctctcggggccgggccgggtgggtgcgggcgccggggcctccgggagaagccgccggccggggcgctccgtgcgcgccgcacctgctgggccgcggggctcctactggggcgcgggctggtggctgggccgcgggggcggcgagtcgtcctccgaggagcagtcggaggaggcggcgtggacgctggcgccgttgctgtaggggaaatggtcctcgtcgtcctcgtcctcgtcctcctcggggtcactgtccctcaagtcccgcaggcggcgtccgctgcccttgtctccgggcgctggcggccccagcagctcctcggctcccggctcctccgcgccgcccttccccgcgcccccgccgccgcccttctgtttctccgcttcctgcgccgcctgctctttggcctttttgctgcgtttccatttcatccgccggttctggaaccaaatcttcacctgcgggcacaagcgggcgtgagaaaccggccaccgccaccccagggcttcctgtccccggagtcccccggccgcgtgcgcctgggccccattgggtcggccctggaatggcctcagggtgagacgacttagaagcagaatggggagggggctcgtagcttcctcctccccgcaaccccccactcagcagcaaaccccagagctgggctggagctccgtgggagctaggactatgtccccaacgacccaggccggggacttttctacccgcgccctccgtctgcggaggaagggtcagggcagctggctacgtcgcggtaaatctcaggatgttccctcctctctttctggaacaaaatttctcgaatgcggcctggggatcaccttcttcagaatgaaaggaggggtggttaagtgctgattcttgggccccacccgaagctactgaatcggcgctctgggcaccttagatgaacccgtgcgcccgccgtctgaaccgtcgaggcgcagcgctagatgcctcagaccgcccgtgggtcacaagtgcaaaggtaacagtgtcccctgggaggccgggatgcgtcgggggcggggagggcgcgcacctgggtctcggtgagcatgagcgaggtggccacctcgaagcgcttgggccgcgacaggtacttgttgagcttgaactggtgctccagctccagcagctgctggctggtgaaggcggtgcgcggccggcggcacttccccaggaggttcgactgcgcctgggctggggaccaaagggcagtgaggcccacagccggctccggtcctcgccccagcccctcccgttgctgcttgtaccactacactcaaggccccagcgccaaggcctggccctgcagagggcggggctgttccctcactatcagtgcccactccccaaggaatgcggactcaggaccac

SEQ ID NO: 128671 - DNA, 225 bp, Homo sapiens; identical to SEQ ID NO: 96830
  misc_feature 1..225: note = chr7:156800853-156801078
  misc_feature 1..225: note = Hyper
  source 1..225: mol_type = genomic DNA

SEQ ID NO: 128672 - DNA, 761 bp, Homo sapiens
  misc_feature 1..761: note = chr7:156801403-156802164
  misc_feature 1..761: note = Hyper
  source 1..761: mol_type = genomic DNA
ctttgtttgggtgttcggcggctgaaagcgttgagccatatacatctgctcggcccgactcataagtagctgaccccgatggggcgagcggggagagccagagccccagagagccagagccccggagccccagcccggagagtccgcgtgtgccaggaaagcctgaggggcccaggcctctggcgaggtgtcccgcccggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctccgaagcccatttctcttgtttgctgctcctgaagcactccctctccctggaggggccgcgggtctctctaacgccccagtgggggacctggcccaagttcctttccccggtgataagccctgacccccattcccgggcctgcctaattcagggcgctctcggctcgccttcccccggcgacttccttctcctgcagccttcgggttaatcattagatctcagtctcacacctccaactgccccttcccgttaagagaggaagagaaggcaaggcctgcgcatggccatttta

SEQ ID NO: 128673 - DNA, 124 bp, Homo sapiens; identical to SEQ ID NO: 96833
  misc_feature 1..124: note = chr7:156802413-156802537
  misc_feature 1..124: note = Hyper
  source 1..124: mol_type = genomic DNA

SEQ ID NO: 128674 - DNA, 74 bp, Homo sapiens; identical to SEQ ID NO: 96834
  misc_feature 1..74: note = chr7:156803722-156803796
  misc_feature 1..74: note = Hyper
  source 1..74: mol_type = genomic DNA

SEQ ID NO: 128675 - DNA, 796 bp, Homo sapiens
  misc_feature 1..796: note = chr7:156808858-156809654
  misc_feature 1..796: note = Hyper
  source 1..796: mol_type = genomic DNA
tagcattggcctgggcgcccaggcactcctttagaacccacctgttccccccacccaccctagtgggaggaggagagggttacactgacagataccggcagctctgcaacccgggaacaacgcagacaacatacaactcgacagagtcacagaaggtggcgtccatcgcgcctggatggtgactactgccctgcgggctgctgggtgggtgaaacacacagggaagaagcacaaatacacacacagatgtggctcagggacatttgaatgcttcagtgtgtgaattttttagcgcattctgactcgaaattatggctgaatagtggcgcactaatgtccaagtccatgttcgataatggcaggaagtctgcactaattggtctatttagtagttgctgaggtggcaaaagctgcagctgctggtggctgaaagagagagagagagagagagacctcctcttaggccacttcccagagctgtggcagtgggggagggggaattccccaggatggtgtttgtggtcaagttcacctctggcaaccctgcctaagctcttctcacaggtgcacgcattcaagtcctgaagagccctccccgcccccaacagtgttcatgtcccgggctgggggcccgcctgggaggggctctatatgccggtgggacctggctgctttgcctcgcattctccccactcttccccttcccagggcagcttttctccccgcaccccatctctctcccctttgctttctaactgggttgggaagctaatctgccaagagcccgctgcttagc

SEQ ID NO: 128676 - DNA, 1989 bp, Homo sapiens
  misc_feature 1..1989: note = chr7:156810037-156812026
  misc_feature 1..1989: note = Hyper
  source 1..1989: mol_type = genomic DNA
gggagcagcatgggccgccctctgcctcaccgaggggcaaaccggctgaggacccaggcacgaagagtgtcaccagctctgaccacaagccccgtagaccagggctgcgtccataatcggggttgatggcattagttattatattataacctccttgttgcgtgattctagtaatttattttcccacttggcctttgactgggctgggctcctcccagtggaacaacagggggtgtcgtgtttgcagcagaaacgcacactgggatcctttcttgcaacagctgggccggctgggtcttttctcttgtcttctgtacacaggcccctctccgctgtttctgcagagaccgaggtgggagggagaaagaccctccagccctctgctcccaccctccccgcagtctccggggccctgtgctgcaggcaagataatttggctaatgaactcgttaaagggcccctggtgacccgccccggcttcccctcggcccatctgggaaattccattgaaaggctggagaaggttcctcagccccgccgccttctgtcgctgctagaggcgcgaacccggtgactctgggccccttacattaaaataattacccggcggaacaggtggcccactcccggcgcctgggtgcatctgggcccccggagccgcagcccgggaggaggggagcggcacgcccaggggagggaaggtcaggcccgctgagccgggagccgggagggtagagaggggctttcctagggacagacggtcccggggcacccaggcctccgcggccgagcgggctgaggcctaagcagggaggccgtcgccttcaggcacaggtaagcgcagcccgcgcaccgcttgggacgcacctggccacctgcgctgccacccaagcttggggtatgcgggtgcccgagcagaaccccgaactcgcaccgggctccgaggttggagcaactcctaacactgggctcggagctaggggcttgctggaggggcgcttgccgcgccggccctcggggctcacagccgggcacgccggactgcggcgagcgcgtgggcgagcgtgtcaggagcgtgcgccctgggtgcgcgcgtgcgagagcgcacgtgtagggtggcttccagtcctcccttcccgcctgagaagcgtccacgcggagttccaggccgggcgctggggaaggaggtcccggggacgctgctgaaaagagagcggccagcccaggcgcggggccaagcctattgccaaaaacatattaccctgcgacattctgtaaatgagataatgatccataaacccggatgatagatgtggcgtgcctgcgatgtcttctctaaatgagctgctcgcatcgactgctaataatggtgagtttatggaagcgatttcagcgcaaactgcgagagggtcttcttactctaatcagcctgcctgagctaatggacgagggggtcaggctgagagttattgacacgcccgtgcccttaacctgtttcccaataaagctgattagtttttgtcaattcatcagctaaccactcttgctggaactgcatcaaagccttatttgctcaggggaaatcaacaagtcacagatcagctccattaaggggcccggcccggcaaggacagtcctggagccgagggacgccccgacggacctcgggcctcccccgaggttcgcagaggggctgacagcgtggccccccttaactccgagcaccacgacccggatgcacataactgtgtccggaaacttctctttctctgcaggtggagcagcgcctgtgcggctccgcgctatggctccaaggctccggccctggcgtctgggctcggtcggggacagtttccacgcgaggcggagcctagctggaggtcacagggcggtggagagcgagggcatgagggagggagctgggaaccgcgcagtgtccgcggccacgaatctctcctacgcgtccccatgaggcgacctaaggggaag

SEQ ID NO: 128677 - DNA, 37 bp, Homo sapiens; identical to SEQ ID NO: 31706
  misc_feature 1..37: note = chr7:156812242-156812279
  misc_feature 1..37: note = Hyper
  source 1..37: mol_type = genomic DNA

SEQ ID NO: 128678 - DNA, 2304 bp, Homo sapiens
  misc_feature 1..2304: note = chr7:156812788-156815092
  misc_feature 1..2304: note = Hyper
  source 1..2304: mol_type = genomic DNA
taaggatattgtatacgcggggggtatgctttattgacaatttcattttccaattagtaattttgttgtaatatatctgcgaaccggggactcccgggcagggaggcaggattctcccggctggggcggtctgagtagctgggtctgagcctcgggctgagaagagtaaattctgcagaaagggccgcgtccgatcggcgcaaacgttcggttcgtagcaggagcttctccaggcggccaccgaacccaggtccaggactcggcactcctggagccctcctccccacgcagaccgcgggggctgatttaatagaatgtcgatagaatcattcgatgccttttagcttgtgatctttataaatgtccctctattaaattagaaaatgattctcttctcgtttaattgtattctttcgtttcttatttccaattaattagtcctatcgacgttgcaatattttaagtgacttgagtccgtttccagttagaatatatgggtcagcacatgcaattttatacccgacaggactatataatgtgggttttaactactcgttcctcatctgtcttaaacatctggccaggatgcgccacccggcctcctcgcagatccttcctggggcaggtgggcaccacgcgggaccctcccgggggctcccgcaggcgcctcttgctgcccggggccaagggtcgggcagcccatagcgtccggcctgggcctttacttggaattctttctgttgaagacttggtcccagcccagtggttctgggataagaagaccccgcagaggggcccagcgccgcgttcctacgagacacctgagctgcactgtgtttccacgggctaggagagcggtgactccccagcctccccgtaggcctcgctcgcaccgcagagggatggctggcccgtgccgctccgcggttcccctccccgggcggatccgcgcagggagagcccggcgggcctgggcttgggcctgggcctggttcgggggtgcaggccaagaggggcgccaggccgggctcccctacccgagcacgtcagttccaccccctcccttcttgctgccctacaaaactttaaaatcactttttaaaagaccgtgtctcctctcggcagcccccctcgacctcttcgcaggcgcctgagcagccccgcaccgaggggcgcacctttgcttttgcgagctgcgcggcgcggacacccgggctgcgctcagcccccacccccacaggcttcccagccgtctgcccgagttcggcttcaacgggagcggggctccacttttccttaattgacgaagtcacggattcctcccgggcggatttatggggctgcgcgttgtgccggcgcccgctgcttcgcatctgcgcgcccgcccggtgccgggccccgccctccgcctcagccccaagctcggcccgcgggcccggccacaggtgccccggcggccccgcctggcccgagggaagagggcagctgggaggggccccggccgccgcccgttcctgctgcgggtgagcaccaggtccccgcgggccttgcgcggtgccccccagctcagcgtggcgctcggcggcccaaggtctggggcgtggagggcgtcagcacctggccgactcgccggttcccataggctgcctcgccccgcgttttcctagcgggggatggcggctccccgtgtccgcatcgctgccgggccctgccaccccaaccccggccgcagtggctggaagccgtggccttttccgggctccgagagccggcggggcggttttcctccgggtttcctcccgccggggtcttgggagcccctcagcctcgccctccctgcagggagaaacctgtctactgcgtgaatttctaagcagctgatccttcaggcccaagactcctagagtggaaagggttccccggaatagtaagcgcgccgtcaccttgggtttcttcttcccagagcaaggagacccccgttttcctcatgacccgcgtcctaaaaggtggggaggtgagattcactgggaatcgtgaacctgcccccggcttctcccggggcagcctcccccggtcaggggaggagggagcccttcccttcaaccccgaaaggttccttcctggtccctagctttgctctttgcaggcagggatggggctggcacgccttgcggagaattttaccgttttaaatatggacctagaggccaggtcggaaaggggaaagaagctgcgccttgccgagggtcctgtggccggagcagggcctgactcctgactcccatccagcgccccttctagaaa

SEQ ID NO: 128679 - DNA, 30 bp, Homo sapiens; identical to SEQ ID NO: 96843
  misc_feature 1..30: note = chr7:156815392-156815422
  misc_feature 1..30: note = Hyper
  source 1..30: mol_type = genomic DNA

SEQ ID NO: 128680 - DNA, 209 bp, Homo sapiens; identical to SEQ ID NO: 96844
  misc_feature 1..209: note = chr7:156832193-156832402
  misc_feature 1..209: note = Hypo
  source 1..209: mol_type = genomic DNA

SEQ ID NO: 128681 - DNA, 500 bp, Homo sapiens; identical to SEQ ID NO: 96845
  misc_feature 1..500: note = chr7:156832680-156833180
  misc_feature 1..500: note = Hypo
  source 1..500: mol_type = genomic DNA

SEQ ID NO: 128682 - DNA, 340 bp, Homo sapiens
  misc_feature 1..340: note = chr7:156871012-156871352
  misc_feature 1..340: note = Hyper
  source 1..340: mol_type = genomic DNA
gggctcccctaaatccgaagctatcccctgccctcccttcctcgcgtggcttcccgggcgcgctctgcctgtctgcggggactccaggcgtccttgtgttttcagctcccggctcttgcccgcgcgtgtggcccggctgggcgctcgggcttcctcctcccaggcccgcggcggcttcccgtcctcgcaggcgcgatcttaccccggccggacagttaggacgcggttgtgctgacctgaggcttggccctgactcccgtgcacagcgcccgagctccagaggcgggggatctgaacactggcctgtgaaccccgagaaaacccccggtttgcagaccag

SEQ ID NO: 128683 - DNA, 68 bp, Homo sapiens; identical to SEQ ID NO: 41560
  misc_feature 1..68: note = chr7:156880531-156880599
  misc_feature 1..68: note = Hypo
  source 1..68: mol_type = genomic DNA

SEQ ID NO: 128684 - DNA, 411 bp, Homo sapiens; identical to SEQ ID NO: 96849
  misc_feature 1..411: note = chr7:156883232-156883643
  misc_feature 1..411: note = Hypo
  source 1..411: mol_type = genomic DNA

SEQ ID NO: 128685 - DNA, 31 bp, Homo sapiens; identical to SEQ ID NO: 96850
  misc_feature 1..31: note = chr7:156922797-156922828
  misc_feature 1..31: note = Hypo
  source 1..31: mol_type = genomic DNA

SEQ ID NO: 128686 - DNA, 47 bp, Homo sapiens; identical to SEQ ID NO: 96851
  misc_feature 1..47: note = chr7:156924103-156924150
  misc_feature 1..47: note = Hypo
  source 1..47: mol_type = genomic DNA

SEQ ID NO: 128687 - DNA, 21 bp, Homo sapiens
  misc_feature 1..21: note = chr7:156929628-156929649
  misc_feature 1..21: note = Hypo
  source 1..21: mol_type = genomic DNA
ttatttattttgagacggagt

SEQ ID NO: 128688 - DNA, 30 bp, Homo sapiens; identical to SEQ ID NO: 96853
  misc_feature 1..30: note = chr7:157074398-157074428
  misc_feature 1..30: note = Hypo
  source 1..30: mol_type = genomic DNA

SEQ ID NO: 128689 - DNA, 219 bp, Homo sapiens; identical to SEQ ID NO: 96854
  misc_feature 1..219: note = chr7:157075184-157075403
  misc_feature 1..219: note = Hypo
  source 1..219: mol_type = genomic DNA

SEQ ID NO: 128690 - DNA, 113 bp, Homo sapiens; identical to SEQ ID NO: 96855
  misc_feature 1..113: note = chr7:157082014-157082127
  misc_feature 1..113: note = Hypo
  source 1..113: mol_type = genomic DNA

SEQ ID NO: 128691 - DNA, 212 bp, Homo sapiens; identical to SEQ ID NO: 96856
  misc_feature 1..212: note = chr7:157084410-157084622
  misc_feature 1..212: note = Hypo
  source 1..212: mol_type = genomic DNA

SEQ ID NO: 128692 - DNA, 291 bp, Homo sapiens; identical to SEQ ID NO: 96857
  misc_feature 1..291: note = chr7:157085343-157085634
  misc_feature 1..291: note = Hypo
  source 1..291: mol_type = genomic DNA

SEQ ID NO: 128693 - DNA, 221 bp, Homo sapiens; identical to SEQ ID NO: 41567
  misc_feature 1..221: note = chr7:157085926-157086147
  misc_feature 1..221: note = Hypo
  source 1..221: mol_type = genomic DNA

SEQ ID NO: 128694 - DNA, 71 bp, Homo sapiens; identical to SEQ ID NO: 41568
  misc_feature 1..71: note = chr7:157099869-157099940
  misc_feature 1..71: note = Hypo
  source 1..71: mol_type = genomic DNA

SEQ ID NO: 128695 - DNA, 27 bp, Homo sapiens
  misc_feature 1..27: note = chr7:157110643-157110670
  misc_feature 1..27: note = Hypo
  source 1..27: mol_type = genomic DNA
ggcatgagccaccgcacccagcccact

SEQ ID NO: 128696 - DNA, 211 bp, Homo sapiens; identical to SEQ ID NO: 96861
  misc_feature 1..211: note = chr7:157129074-157129285
  misc_feature 1..211: note = Hyper
  source 1..211: mol_type = genomic DNA

SEQ ID NO: 128697 - DNA, 49 bp, Homo sapiens; identical to SEQ ID NO: 31712
  misc_feature 1..49: note = chr7:157130967-157131016
  misc_feature 1..49: note = Hyper
  source 1..49: mol_type = genomic DNA

SEQ ID NO: 128698 - DNA, 41 bp, Homo sapiens; identical to SEQ ID NO: 96863
  misc_feature 1..41: note = chr7:157147812-157147853
  misc_feature 1..41: note = Hypo
  source 1..41: mol_type = genomic DNA

SEQ ID NO: 128699 - DNA, 30 bp, Homo sapiens; identical to SEQ ID NO: 96864
  misc_feature 1..30: note = chr7:157151821-157151851
  misc_feature 1..30: note = Hypo
  source 1..30: mol_type = genomic DNA

SEQ ID NO: 128700 - DNA, 59 bp, Homo sapiens; identical to SEQ ID NO: 96865
  misc_feature 1..59: note = chr7:157200748-157200807
  misc_feature 1..59: note = Hypo
  source 1..59: mol_type = genomic DNA

SEQ ID NO: 128701 - DNA, 48 bp, Homo sapiens; identical to SEQ ID NO: 41570
  misc_feature 1..48: note = chr7:157217366-157217414
  misc_feature 1..48: note = Hypo
  source 1..48: mol_type = genomic DNA

SEQ ID NO: 128702 - DNA, 102 bp, Homo sapiens; identical to SEQ ID NO: 96867
  misc_feature 1..102: note = chr7:157217837-157217939
  misc_feature 1..102: note = Hypo
  source 1..102: mol_type = genomic DNA

SEQ ID NO: 128703 - DNA, 232 bp, Homo sapiens; identical to SEQ ID NO: 96868
  misc_feature 1..232: note = chr7:157218481-157218713
  misc_feature 1..232: note = Hypo
  source 1..232: mol_type = genomic DNA

SEQ ID NO: 128704 - DNA, 153 bp, Homo sapiens; identical to SEQ ID NO: 96869
  misc_feature 1..153: note = chr7:157220472-157220625
  misc_feature 1..153: note = Hypo
  source 1..153: mol_type = genomic DNA

SEQ ID NO: 128705 - DNA, 58 bp, Homo sapiens; identical to SEQ ID NO: 96870
  misc_feature 1..58: note = chr7:157233964-157234022
  misc_feature 1..58: note = Hypo
  source 1..58: mol_type = genomic DNA

SEQ ID NO: 128706 - DNA, 123 bp, Homo sapiens; identical to SEQ ID NO: 96871
  misc_feature 1..123: note = chr7:157235673-157235796
  misc_feature 1..123: note = Hypo
  source 1..123: mol_type = genomic DNA

SEQ ID NO: 128707 - DNA, 178 bp, Homo sapiens; identical to SEQ ID NO: 96872
  misc_feature 1..178: note = chr7:157239495-157239673
  misc_feature 1..178: note = Hypo
  source 1..178: mol_type = genomic DNA

SEQ ID NO: 128708 - DNA, 261 bp, Homo sapiens; identical to SEQ ID NO: 41575
  misc_feature 1..261: note = chr7:157255061-157255322
  misc_feature 1..261: note = Hypo
  source 1..261: mol_type = genomic DNA

SEQ ID NO: 128709 - DNA, 30 bp, Homo sapiens; identical to SEQ ID NO: 96876
  misc_feature 1..30: note = chr7:157261056-157261086
  misc_feature 1..30: note = Hypo
  source 1..30: mol_type = genomic DNA

SEQ ID NO: 128710 - DNA, 944 bp, Homo sapiens; identical to SEQ ID NO: 96877
  misc_feature 1..944: note = chr7:157262527-157263471
  misc_feature 1..944: note = Hypo
  source 1..944: mol_type = genomic DNA

SEQ ID NO: 128711 - DNA, 17 bp, Homo sapiens
  misc_feature 1..17: note = chr7:157271529-157271546
  misc_feature 1..17: note = Hypo
  source 1..17: mol_type = genomic DNA
ggcgtgaaccaccgcgc

SEQ ID NO: 128712 - DNA, 30 bp, Homo sapiens; identical to SEQ ID NO: 96880
  misc_feature 1..30: note = chr7:157271776-157271806
  misc_feature 1..30: note = Hypo
  source 1..30: mol_type = genomic DNA

SEQ ID NO: 128713 - DNA, 92 bp, Homo sapiens; identical to SEQ ID NO: 96882
  misc_feature 1..92: note = chr7:157274739-157274831
  misc_feature 1..92: note = Hypo
  source 1..92: mol_type = genomic DNA

SEQ ID NO: 128714 - DNA, 53 bp, Homo sapiens; identical to SEQ ID NO: 96883
  misc_feature 1..53: note = chr7:157276004-157276057
  misc_feature 1..53: note = Hypo
  source 1..53: mol_type = genomic DNA

SEQ ID NO: 128715 - DNA, 158 bp, Homo sapiens; identical to SEQ ID NO: 96884
  misc_feature 1..158: note = chr7:157276262-157276420
  misc_feature 1..158: note = Hypo
  source 1..158: mol_type = genomic DNA

SEQ ID NO: 128716 - DNA, 256 bp, Homo sapiens; identical to SEQ ID NO: 96885
  misc_feature 1..256: note = chr7:157277538-157277794
  misc_feature 1..256: note = Hypo
  source 1..256: mol_type = genomic DNA

SEQ ID NO: 128717 - DNA, 174 bp, Homo sapiens; identical to SEQ ID NO: 96886
  misc_feature 1..174: note = chr7:157280193-157280367
  misc_feature 1..174: note = Hypo
  source 1..174: mol_type = genomic DNA

SEQ ID NO: 128718 - DNA, 170 bp, Homo sapiens; identical to SEQ ID NO: 96887
  misc_feature 1..170: note = chr7:157280604-157280774
  misc_feature 1..170: note = Hypo
  source 1..170: mol_type = genomic DNA

SEQ ID NO: 128719 - DNA, 409 bp, Homo sapiens; identical to SEQ ID NO: 96888
  misc_feature 1..409: note = chr7:157291421-157291830
  misc_feature 1..409: note = Hypo
  source 1..409: mol_type = genomic DNA

SEQ ID NO: 128720 - DNA, 230 bp, Homo sapiens; identical to SEQ ID NO: 96889
  misc_feature 1..230: note = chr7:157294091-157294321
  misc_feature 1..230: note = Hypo
  source 1..230: mol_type = genomic DNA

SEQ ID NO: 128721 - DNA, 30 bp, Homo sapiens; identical to SEQ ID NO: 96890
  misc_feature 1..30: note = chr7:157314286-157314316
  misc_feature 1..30: note = Hypo
  source 1..30: mol_type = genomic DNA

SEQ ID NO: 128722 - DNA, 30 bp, Homo sapiens; identical to SEQ ID NO: 96891
  misc_feature 1..30: note = chr7:157318443-157318473
  misc_feature 1..30: note = Hypo
  source 1..30: mol_type = genomic DNA

SEQ ID NO: 128723 - DNA, 227 bp, Homo sapiens; identical to SEQ ID NO: 96892
  misc_feature 1..227: note = chr7:157319475-157319702
  misc_feature 1..227: note = Hypo
  source 1..227: mol_type = genomic DNA

SEQ ID NO: 128724 - DNA, 30 bp, Homo sapiens; identical to SEQ ID NO: 96893
  misc_feature 1..30: note = chr7:157320033-157320063
  misc_feature 1..30: note = Hypo
  source 1..30: mol_type = genomic DNA

SEQ ID NO: 128725 - DNA, 63 bp, Homo sapiens; identical to SEQ ID NO: 96894
  misc_feature 1..63: note = chr7:157320767-157320830
  misc_feature 1..63: note = Hypo
  source 1..63: mol_type = genomic DNA

SEQ ID NO: 128726 - DNA, 30 bp, Homo sapiens; identical to SEQ ID NO: 96895
  misc_feature 1..30: note = chr7:157332948-157332978
  misc_feature 1..30: note = Hypo
  source 1..30: mol_type = genomic DNA

SEQ ID NO: 128727 - DNA, 30 bp, Homo sapiens; identical to SEQ ID NO: 96896
  misc_feature 1..30: note = chr7:157334100-157334130
  misc_feature 1..30: note = Hypo
  source 1..30: mol_type = genomic DNA

SEQ ID NO: 128728 - DNA, 71 bp, Homo sapiens; identical to SEQ ID NO: 96897
  misc_feature 1..71: note = chr7:157336122-157336193
  misc_feature 1..71: note = Hypo
  source 1..71: mol_type = genomic DNA

SEQ ID NO: 128729 - DNA, 142 bp, Homo sapiens; identical to SEQ ID NO: 41584
  misc_feature 1..142: note = chr7:157337964-157338106
  misc_feature 1..142: note = Hypo
  source 1..142: mol_type = genomic DNA

SEQ ID NO: 128730 - DNA, 83 bp, Homo sapiens; identical to SEQ ID NO: 41585
  misc_feature 1..83: note = chr7:157338308-157338391
  misc_feature 1..83: note = Hypo
  source 1..83: mol_type = genomic DNA

SEQ ID NO: 128731 - DNA, 30 bp, Homo sapiens; identical to SEQ ID NO: 96900
  misc_feature 1..30: note = chr7:157340396-157340426
  misc_feature 1..30: note = Hypo
  source 1..30: mol_type = genomic DNA

SEQ ID NO: 128732 - DNA, 156 bp, Homo sapiens; identical to SEQ ID NO: 96901
  misc_feature 1..156: note = chr7:157341515-157341671
  misc_feature 1..156: note = Hypo
  source 1..156: mol_type = genomic DNA

SEQ ID NO: 128733 - DNA, 88 bp, Homo sapiens; identical to SEQ ID NO: 96902
  misc_feature 1..88: note = chr7:157346653-157346741
  misc_feature 1..88: note = Hypo
  source 1..88: mol_type = genomic DNA

SEQ ID NO: 128734 - DNA, 155 bp, Homo sapiens; identical to SEQ ID NO: 96903
  misc_feature 1..155: note = chr7:157346979-157347134
  misc_feature 1..155: note = Hypo
  source 1..155: mol_type = genomic DNA

SEQ ID NO: 128735 - DNA, 47 bp, Homo sapiens; identical to SEQ ID NO: 96904
  misc_feature 1..47: note = chr7:157347797-157347844
  misc_feature 1..47: note = Hypo
  source 1..47: mol_type = genomic DNA

SEQ ID NO: 128736 - DNA, 30 bp, Homo sapiens; identical to SEQ ID NO: 96905
  misc_feature 1..30: note = chr7:157348767-157348797
  misc_feature 1..30: note = Hypo
  source 1..30: mol_type = genomic DNA

SEQ ID NO: 128737 - DNA, 76 bp, Homo sapiens; identical to SEQ ID NO: 96906
  misc_feature 1..76: note = chr7:157350791-157350867
  misc_feature 1..76: note = Hypo
  source 1..76: mol_type = genomic DNA

SEQ ID NO: 128738 - DNA, 149 bp, Homo sapiens; identical to SEQ ID NO: 96907
  misc_feature 1..149: note = chr7:157352962-157353111
  misc_feature 1..149: note = Hypo
  source 1..149: mol_type = genomic DNA

SEQ ID NO: 128739 - DNA, 48 bp, Homo sapiens; identical to SEQ ID NO: 96908
  misc_feature 1..48: note = chr7:157361605-157361653
  misc_feature 1..48: note = Hyper
  source 1..48: mol_type = genomic DNA

SEQ ID NO: 128740 - DNA, 39 bp, Homo sapiens; identical to SEQ ID NO: 96909
  misc_feature 1..39: note = chr7:157367437-157367476
  misc_feature 1..39: note = Hypo
  source 1..39: mol_type = genomic DNA

SEQ ID NO: 128741 - DNA, 319 bp, Homo sapiens; identical to SEQ ID NO: 96910
  misc_feature 1..319: note = chr7:157370470-157370789
  misc_feature 1..319: note = Hypo
  source 1..319: mol_type = genomic DNA

SEQ ID NO: 128742 - DNA, 30 bp, Homo sapiens; identical to SEQ ID NO: 96911
  misc_feature 1..30: note = chr7:157372062-157372092
  misc_feature 1..30: note = Hypo
  source 1..30: mol_type = genomic DNA

SEQ ID NO: 128743 - DNA, 30 bp, Homo sapiens; identical to SEQ ID NO: 96912
  misc_feature 1..30: note = chr7:157381230-157381260
  misc_feature 1..30: note = Hypo
  source 1..30: mol_type = genomic DNA

SEQ ID NO: 128744 - DNA, 378 bp, Homo sapiens; identical to SEQ ID NO: 96913
  misc_feature 1..378: note = chr7:157396375-157396753
  misc_feature 1..378: note = Hypo
  source 1..378: mol_type = genomic DNA

SEQ ID NO: 128745 - DNA, 35 bp, Homo sapiens; identical to SEQ ID NO: 96914
  misc_feature 1..35: note = chr7:157402619-157402654
  misc_feature 1..35: note = Hypo
  source 1..35: mol_type = genomic DNA

SEQ ID NO: 128746 - DNA, 202 bp, Homo sapiens; identical to SEQ ID NO: 96915
  misc_feature 1..202: note = chr7:157403604-157403806
  misc_feature 1..202: note = Hypo
  source 1..202: mol_type = genomic DNA

SEQ ID NO: 128747 - DNA, 30 bp, Homo sapiens; identical to SEQ ID NO: 96916
  misc_feature 1..30: note = chr7:157404012-157404042
  misc_feature 1..30: note = Hypo
  source 1..30: mol_type = genomic DNA

SEQ ID NO: 128748 - DNA, 198 bp, Homo sapiens; identical to SEQ ID NO: 96917
  misc_feature 1..198: note = chr7:157404368-157404566
  misc_feature 1..198: note = Hypo
  source 1..198: mol_type = genomic DNA

SEQ ID NO: 128749 - DNA, 175 bp, Homo sapiens; identical to SEQ ID NO: 96918
  misc_feature 1..175: note = chr7:157408585-157408760
  misc_feature 1..175: note = Hypo
  source 1..175: mol_type = genomic DNA

SEQ ID NO: 128750 - DNA, 189 bp, Homo sapiens; identical to SEQ ID NO: 96919
  misc_feature 1..189: note = chr7:157409685-157409874
  misc_feature 1..189: note = Hypo
  source 1..189: mol_type = genomic DNA

SEQ ID NO: 128751 - DNA, 49 bp, Homo sapiens; identical to SEQ ID NO: 96920
  misc_feature 1..49: note = chr7:157414092-157414141
  misc_feature 1..49: note = Hypo
  source 1..49: mol_type = genomic DNA

SEQ ID NO: 128752 - DNA, 101 bp, Homo sapiens; identical to SEQ ID NO: 41594
  misc_feature 1..101: note = chr7:157437497-157437598
  misc_feature 1..101: note = Hypo
  source 1..101: mol_type = genomic DNA

SEQ ID NO: 128753 - DNA, 84 bp, Homo sapiens; identical to SEQ ID NO: 96922
  misc_feature 1..84: note = chr7:157443172-157443256
  misc_feature 1..84: note = Hypo
  source 1..84: mol_type = genomic DNA

SEQ ID NO: 128754 - DNA, 72 bp, Homo sapiens; identical to SEQ ID NO: 96923
  misc_feature 1..72: note = chr7:157446076-157446148
  misc_feature 1..72: note = Hypo
  source 1..72: mol_type = genomic DNA

SEQ ID NO: 128755 - DNA, 123 bp, Homo sapiens; identical to SEQ ID NO: 96924
  misc_feature 1..123: note = chr7:157448403-157448526
  misc_feature 1..123: note = Hypo
  source 1..123: mol_type = genomic DNA

SEQ ID NO: 128756 - DNA, 30 bp, Homo sapiens; identical to SEQ ID NO: 96925
  misc_feature 1..30: note = chr7:157448928-157448958
  misc_feature 1..30: note = Hypo
  source 1..30: mol_type = genomic DNA

SEQ ID NO: 128757 - DNA, 231 bp, Homo sapiens; identical to SEQ ID NO: 96926
  misc_feature 1..231: note = chr7:157449174-157449405
  misc_feature 1..231: note = Hypo
  source 1..231: mol_type = genomic DNA

SEQ ID NO: 128758 - DNA, 106 bp, Homo sapiens; identical to SEQ ID NO: 96927
  misc_feature 1..106: note = chr7:157453759-157453865
  misc_feature 1..106: note = Hypo
  source 1..106: mol_type = genomic DNA

SEQ ID NO: 128759 - DNA, 125 bp, Homo sapiens; identical to SEQ ID NO: 96928
  misc_feature 1..125: note = chr7:157455446-157455571
  misc_feature 1..125: note = Hypo
  source 1..125: mol_type = genomic DNA

SEQ ID NO: 128760 - DNA, 30 bp, Homo sapiens; identical to SEQ ID NO: 41599
  misc_feature 1..30: note = chr7:157455840-157455870
  misc_feature 1..30: note = Hypo
  source 1..30: mol_type = genomic DNA

SEQ ID NO: 128761 - DNA, 53 bp, Homo sapiens; identical to SEQ ID NO: 96930
  misc_feature 1..53: note = chr7:157457934-157457987
  misc_feature 1..53: note = Hypo
  source 1..53: mol_type = genomic DNA

SEQ ID NO: 128762 - DNA, 48 bp, Homo sapiens; identical to SEQ ID NO: 96931
  misc_feature 1..48: note = chr7:157462508-157462556
  misc_feature 1..48: note = Hypo
  source 1..48: mol_type = genomic DNA

SEQ ID NO: 128763 - DNA, 165 bp, Homo sapiens; identical to SEQ ID NO: 96932
  misc_feature 1..165: note = chr7:157464660-157464825
  misc_feature 1..165: note = Hypo
  source 1..165: mol_type = genomic DNA

SEQ ID NO: 128764 - DNA, 110 bp, Homo sapiens; identical to SEQ ID NO: 96933
  misc_feature 1..110: note = chr7:157467603-157467713
  misc_feature 1..110: note = Hypo
  source 1..110: mol_type = genomic DNA

SEQ ID NO: 128765 - DNA, 45 bp, Homo sapiens; identical to SEQ ID NO: 96934
  misc_feature 1..45: note = chr7:157468290-157468335
  misc_feature 1..45: note = Hypo
  source 1..45: mol_type = genomic DNA

SEQ ID NO: 128766 - DNA, 100 bp, Homo sapiens; identical to SEQ ID NO: 96935
  misc_feature 1..100: note = chr7:157476555-157476655
  misc_feature 1..100: note = Hyper
  source 1..100: mol_type = genomic DNA

SEQ ID NO: 128767 - DNA, 1095 bp, Homo sapiens
  misc_feature 1..1095: note = chr7:157476871-157477966
  misc_feature 1..1095: note = Hyper
  source 1..1095: mol_type = genomic DNA
gcctccttttgccttcggtgcagcggattagctggtgccgggactgagttaatggaaacgcgggttaaatgagaaaagacgcccggattttcctgcctggatgcgcggctcggaggaggaccgcgaggttctccagcggcgggaggcggtggagccgccgcggagagggagggaggctttggagagggagggaaggaaagggggagggagagggaaaggggggagagggagaggaggcgcggggtgggggaggggagtgagcagggagccgggagagggaggaggggcgggaaccaggggagcggcccgaaccccgtttggtccggaccccgcagccaccgctgggtctcgccgccgggtcgcccttcgcgtggagatccggtccgcgccccctccccggtctcctcccctcccctcccctccgcccccctccctccggcccacacagcctcttccagaaagaagtcactctagagccgcgcgacccagccccagagtccgccggggtccgcccaccgggtctcctgcgcgcccctccccgcccctccccgggcacagcccgttcacgaaacctaaggcgccggccacgcgccacctcccccgggccggggtctcctcggtccccgcgcgggcgctggttctcccgggtgggcggcagccccgccctgtgccctcctgggccggcgcgagggaccctagagcgcgcggggggccccaggcggggaggagcggccgcgaccccggatgcgagaggcgtgtgggtccaagcggcgccgggacaggggccgggtcctctgcccaccccagggtccatgttcgcctgcggggccgcgtcccccggagccatacctgggcgggagggcttttcccgggggcccggcctgcgcccctcgccgcccctcgcccctcgcctctcgcctcccgcgggtcccgcctggccttggccgacggaacaagaacaacaaaggaagcggcgcgaccggcggagggggcgcccgccgccctcccacccctcatcccggccgggccgatggcccccgcgcgcctccatccgccccagcgcggaggcgaccccggccccgctgccccggcgtc

SEQ ID NO: 128768 - DNA, 38 bp, Homo sapiens
  misc_feature 1..38: note = chr7:157478722-157478760
  misc_feature 1..38: note = Hyper
  source 1..38: mol_type = genomic DNA
ggacagccggggagtcgtgaccgcgggcagcgccgggg

SEQ ID NO: 128769 - DNA, 5307 bp, Homo sapiens
  misc_feature 1..5307: note = chr7:157481364-157486671
  misc_feature 1..5307: note = Hyper
  source 1..5307: mol_type = genomic DNA
ggggggttaccgcttcgcctcctctacccggactcagaagccccaacccaagacccgcctagcgtcgcttgtcagaacccctctgtggcacgactttgagcagagggcgagggaaaggagggtcagcgttcggccccgtcccctgcctgggctttctcccccgcttccccgtccctcccccctcgccggttcaccgcatccccacaggagtcataaagatcaggccccagcgccggacacaaaggccaagggttcccgggagccgcgggtattcagagccaggagaggggtcccggcgcggagggtgctgcggcccagcctcctggccacagagcgcgccggccgcgagggaggaccaaggtccccaaccacgcccgcgtccacccgtgaatcccggcgctcgcagcccccgggcggcgcagccgccaccgccgccgtcttctctggagcgcagaggggtgtgcttgggagggggcgggagggcactttcctctgtgtcggtgaaaggaagagcttccagctccctcctccgcacaaaccttcacttcctctcttgttcgatcgcgtcctaaaatctgggatcggcgacgcaaggacagcctggtttggcgaagacccctcggacaccctgcgctccggactccaggcgggtggctccacggtgccggccgggacgcgcagctcggggggcgggaccacgtccgggaccccggggccgctgtccgaggacggaggtcggtgacttgaaccgcgtcgtcctcagggctgtggcggggcccctctcccagccgtccagcccgcagcgcccagctcagcgcactgaggaccaaaaagggcgggagactctctccggccctaaaaggcaattgtgctgagattttaactctaacttgggggttcgcccgattccctggagcaacgcttctctaaaaccacggagcaggccagtgttcggaactgcacaggtagttacgaaggaaggaaatgaagtccctcgttccaacagcttcgggtccagtcacaagtttctctctggcgagcacgcggccgcctcacctggggtgggggaggcgctgagaaagcgcagttctctttgggggaggagagatggcctctcagaggcgtccccacctgcctctggaacgcctctccctgcaggccccctcggttccctgcaattcgccgcccgctgggatactcccatggctcggaggcgcgctcccggaccctggtgaggagggtgaagagcgccccaaaatgggctgagaggaaaatgcgcccacactggcgcctctccatcctggctgctcgccccttccctcctcctttcccacacgcctcccatctccgtgcctgcacccccccacccccagcaccctgcaatggtcggaactgcagggagtggggagcaacgcgaaaggccgagagaagagcgctggggagaagtcccggaggtcctagactccttggggcggtctctgcggggcgctgggccaggacagctgccaaccctccaaatctgtgcgctcagaaggagctgccctttgcccgctcctcctcacaggcccaccctagacccacttggggatgatcccaggcgcagctctcccctgccggcccaagcctttgacaggagtcctgcggcgaggcagagaccccctgaactgagctctccgacgccctagttgcccgttagagcccccatgcgcgccctccagccttcgaaagctctcttcctcgccccaccacctacgcgcctggtgatgctctcgtgggcccttcctgctccctccgcccccatcccagcctctctcgcctcttccagggcccacccaaccgcactacgagcgcccgcgccccgcccggcacccctggttacctgcagctgggccggcgcccagcgcccgcgcgggaggaggtgggggcgtgcgccgggccgagcggcctcggggcgcagcagctgcgggtagcggcagcgccatcatcacagccagctgcttccctgcgctggagccacagactagcggggtcatccgcttctgaccacaaacttctagggcggccggaggagacaaaggtgccgcgcgtcgctgctccagcagcagcggctgcgcggcggcacgggctcggagcccgcaggcgccggagctctgcgcggccgctcggcccagctccgcgtgctccgccccggcccggcccccgggctaggcacgctgggccggggcgcggcgcgggcgggctcagggcgggctccggacggtcccggtagggccgccggccgcgcgcgtagcaccaaccagcgcggccgccgcgccccgccttatatccggcccggcgcgcacccggccggcggcggcgcggctcgcggcccagccaccggttgctatagcgatgtccccccccccccccacatgttgctgacagcaattggctaaggggccgcggctctccaaacaccctctcccgcccgagactatgaatggacatcagctttgtcagtcattggtacaacgccgaagccagggccttcgccttttctttcttttcagtgtttctccctttcatcgttcatactgggcaagttcagggtagcaccgaggggagagagacctcggccagaaaagtcaaggcgcgcggctctgctgtgacctttgtcctgggaggggtgggtggggtgcgtcgccactcttggcaagagaaaattgcacggcatatcgttcttcccagttaccttttccagtgttgccgttcgggcctttttgctccctttccaaatggaagcaggccaatgattcagggcgagtagacgagagcccctctgctcactttaccagggtcctcccgagtgtttaggtcccgatgcgcgtagaaagtgtcttgcgagacgcggaactggtgagactttgccaccatttggtccaggccaatgtcggccgccagcccaaaacgccgaagggagacggcggtgaaaacccaggcgtgcgagctgcgtccttgcccttccccctacccaggtcaatggtctggcctagaccaccgctctgcgggcgaaaggagtggagcagaatcacaggccacgctcccagtcgttcgagcctgcccacataacccccggcccctggcgcagtcaggcccgcagcgggcgagaagagctagggtctcggggcgactaggaccactgagcacctcccccccgcgcctcccgcccatgctctctctccccaggccctggaccccgggccacagccacaggttggggcaccccggtgcgcggcgcccccgcggagctggcgagagccggagagctgaaacccaacatctgtgtgtacaatgcgctctccgaggcccacagctgcaggaacaaggagaagaaaggaagaggggggcgcagatcttgtcacacgcagatgacagtctgcggagggctctttagtttctccttttctggaaaccccagcggccccctcctaggcccccctctcccaccgcctggccattgttccctgcgcccgggacagctggagacggcggcccgcgccactcgacgcccctcccgccgcacacccggctgcccgcggcgcccgctcccggcccctccggggccaactcctccacaccccccacctccccaggccaggcccaggcggcgcttccacagtctcccctcccctcccttgcactctggcgctgcccctagacctgctcggtgcagagggccttgcctggcgcttttctctcacaaacctagttctgtaaaacctgggggcgagccccagggggcagggctcagaggcgggggttgtccacagatatgagtacggtgccgtccgctgcaggcccctgtctaaaagtggccgaaggaccccgtttcctctgactgcaggcccaggctgagttccgcatttatttttgtatttatagggcaaggccagagcgcttcataaagctccagggcaaagaagtggcctcgcatcgggccatggttcccgcaggcctgagcgggctgcaggaggcccggtgcggctcggcgggggcgcgagaggcgagaaactgcggcgtcactggcgtcctctgcccatgagtgaacccctccagtaggcggggacggggtacatcaccttggccctctcgtcccccctgcccagggcaaggcccgcaaaaacccccgcaccctggctcgggggcggcgcggcggcgggcaggtcagagagaagcggtactcgggttcccccagcgcccgggatgccctcccagggaccttctcgggcaaagagtcgagtggtagcggttcctgtccctccccgccaccctcctccggtgcctcggcgtccccagccaggctccagggcgaccccaggcccggccctgggcagagacagaggaggggaggggaggtggcgctggggggcggggggccggagacggcgggaggaggactcgggagccggggcgggaagaggggaagacagcggagagaagggacggggaggggagggggctcggaggaggggacctgctgccctcagcctggctggtaaccggcctctccatagcaacggccagcgcgcgcgtctgtgtgtgcgcgcgtgtctgatgtgtgtgtgcccgtggtgttcccgggactccccgcgggggctgggaggggatcgcagaaccctagggtggcgacagagcaaacccctccaggactggaggcccgacctccgcggtgctgggagcgccctagggtctggctgcgccgcgctggcgacggggtaggctcggggaacgcgcgcaggccccgggatcggccgctggggcattggggcatcctgccctcgctgccccgaccctcccgctgcggtcgcagggccttggggcaccggggagtgggcgggtcttcccagcgacccggagcacaggggcgggcgacggcgcccccaccatggccctgcccggcccgagcgcccggcgcacctgaggtctgggccggggagcagctggggaaccgcgcgtcgcctcggggagctcccggccaggccggctccgggcagaggccagaggggccctggcgcaccctccccgcccgcggcgacctcgcaccaccttccccgccagcccgcggctctcctcgccctggatcgccggagcctcatccaggctggggtctccagcaggcggccgggagctctccgaggtggccaggagtggccggtagccgtctccctcggccaggccgtgtccagcccctcagtctccacggcggcgcagaccgcacgcggccaccctgggcctcggacagggctagggggacgcagaccctgccgt

SEQ ID NO: 128770 - DNA, 30 bp, Homo sapiens; identical to SEQ ID NO: 96948
  misc_feature 1..30: note = chr7:157505944-157505974
  misc_feature 1..30: note = Hypo
  source 1..30: mol_type = genomic DNA

SEQ ID NO: 128771 - DNA, 54 bp, Homo sapiens; identical to SEQ ID NO: 96949
  misc_feature 1..54: note = chr7:157506246-157506300
  misc_feature 1..54: note = Hypo
  source 1..54: mol_type = genomic DNA

SEQ ID NO: 128772 - DNA, 44 bp, Homo sapiens; identical to SEQ ID NO: 41600
  misc_feature 1..44: note = chr7:157511451-157511495
  misc_feature 1..44: note = Hypo
  source 1..44: mol_type = genomic DNA

SEQ ID NO: 128773 - DNA, 152 bp, Homo sapiens; identical to SEQ ID NO: 41601
  misc_feature 1..152: note = chr7:157512238-157512390
  misc_feature 1..152: note = Hypo
  source 1..152: mol_type = genomic DNA

SEQ ID NO: 128774 - DNA, 216 bp, Homo sapiens; identical to SEQ ID NO: 96952
  misc_feature 1..216: note = chr7:157527539-157527755
  misc_feature 1..216: note = Hypo
  source 1..216: mol_type = genomic DNA

SEQ ID NO: 128775 - DNA, 30 bp, Homo sapiens; identical to SEQ ID NO: 41603
  misc_feature 1..30: note = chr7:157530181-157530211
  misc_feature 1..30: note = Hypo
  source 1..30: mol_type = genomic DNA

SEQ ID NO: 128776 - DNA, 118 bp, Homo sapiens; identical to SEQ ID NO: 96954
  misc_feature 1..118: note = chr7:157536623-157536741
  misc_feature 1..118: note = Hypo
  source 1..118: mol_type = genomic DNA

SEQ ID NO: 128777 - DNA, 30 bp, Homo sapiens; identical to SEQ ID NO: 96955
  misc_feature 1..30: note = chr7:157544564-157544594
  misc_feature 1..30: note = Hypo
  source 1..30: mol_type = genomic DNA

SEQ ID NO: 128778 - DNA, 58 bp, Homo sapiens; identical to SEQ ID NO: 96956
  misc_feature 1..58: note = chr7:157546564-157546622
  misc_feature 1..58: note = Hypo
  source 1..58: mol_type = genomic DNA

SEQ ID NO: 128779 - DNA, 34 bp, Homo sapiens; identical to SEQ ID NO: 96957
  misc_feature 1..34: note = chr7:157550924-157550958
  misc_feature 1..34: note = Hypo
  source 1..34: mol_type = genomic DNA

SEQ ID NO: 128780 - DNA, 103 bp, Homo sapiens; identical to SEQ ID NO: 41605
  misc_feature 1..103: note = chr7:157551220-157551323
  misc_feature 1..103: note = Hypo
  source 1..103: mol_type = genomic DNA

SEQ ID NO: 128781 - DNA, 153 bp, Homo sapiens; identical to SEQ ID NO: 96959
  misc_feature 1..153: note = chr7:157552297-157552450
  misc_feature 1..153: note = Hypo
  source 1..153: mol_type = genomic DNA

SEQ ID NO: 128782 - DNA, 151 bp, Homo sapiens; identical to SEQ ID NO: 96960
  misc_feature 1..151: note = chr7:157565500-157565651
  misc_feature 1..151: note = Hypo
  source 1..151: mol_type = genomic DNA

SEQ ID NO: 128783 - DNA, 134 bp, Homo sapiens; identical to SEQ ID NO: 96961
  misc_feature 1..134: note = chr7:157568187-157568321
  misc_feature 1..134: note = Hypo
  source 1..134: mol_type = genomic DNA

SEQ ID NO: 128784 - DNA, 62 bp, Homo sapiens; identical to SEQ ID NO: 96962
  misc_feature 1..62: note = chr7:157578615-157578677
  misc_feature 1..62: note = Hypo
  source 1..62: mol_type = genomic DNA

SEQ ID NO: 128785 - DNA, 30 bp, Homo sapiens; identical to SEQ ID NO: 96963
  misc_feature 1..30: note = chr7:157581557-157581587
  misc_feature 1..30: note = Hypo
  source 1..30: mol_type = genomic DNA

SEQ ID NO: 128786 - DNA, 341 bp, Homo sapiens; identical to SEQ ID NO: 41609
  misc_feature 1..341: note = chr7:157583900-157584241
  misc_feature 1..341: note = Hypo
  source 1..341: mol_type = genomic DNA

SEQ ID NO: 128787 - DNA, 30 bp, Homo sapiens; identical to SEQ ID NO: 41610
  misc_feature 1..30: note = chr7:157584643-157584673
  misc_feature 1..30: note = Hypo
  source 1..30: mol_type = genomic DNA

SEQ ID NO: 128788 - DNA, 84 bp, Homo sapiens; identical to SEQ ID NO: 96966
  misc_feature 1..84: note = chr7:157585079-157585163
  misc_feature 1..84: note = Hypo
  source 1..84: mol_type = genomic DNA

SEQ ID NO: 128789 - DNA, 441 bp, Homo sapiens; identical to SEQ ID NO: 96967
  misc_feature 1..441: note = chr7:157588586-157589027
  misc_feature 1..441: note = Hypo
  source 1..441: mol_type = genomic DNA

SEQ ID NO: 128790 - DNA, 35 bp, Homo sapiens; identical to SEQ ID NO: 96968
  misc_feature 1..35: note = chr7:157589600-157589635
  misc_feature 1..35: note = Hypo
  source 1..35: mol_type = genomic DNA

SEQ ID NO: 128791 - DNA, 30 bp, Homo sapiens; identical to SEQ ID NO: 41613
  misc_feature 1..30: note = chr7:157601854-157601884
  misc_feature 1..30: note = Hypo
  source 1..30: mol_type = genomic DNA

SEQ ID NO: 128792 - DNA, 33 bp, Homo sapiens; identical to SEQ ID NO: 96970
  misc_feature 1..33: note = chr7:157603115-157603148
  misc_feature 1..33: note = Hypo
  source 1..33: mol_type = genomic DNA

SEQ ID NO: 128793 - DNA, 349 bp, Homo sapiens; identical to SEQ ID NO: 96971
  misc_feature 1..349: note = chr7:157606439-157606788
  misc_feature 1..349: note = Hypo
  source 1..349: mol_type = genomic DNA

SEQ ID NO: 128794 - DNA, 44 bp, Homo sapiens; identical to SEQ ID NO: 96972
  misc_feature 1..44: note = chr7:157607996-157608040
  misc_feature 1..44: note = Hypo
  source 1..44: mol_type = genomic DNA

SEQ ID NO: 128795 - DNA, 30 bp, Homo sapiens; identical to SEQ ID NO: 96973
  misc_feature 1..30: note = chr7:157612336-157612366
  misc_feature 1..30: note = Hypo
  source 1..30: mol_type = genomic DNA

SEQ ID NO: 128796 - DNA, 31 bp, Homo sapiens; identical to SEQ ID NO: 96974
  misc_feature 1..31: note = chr7:157613184-157613215
  misc_feature 1..31: note = Hypo
  source 1..31: mol_type = genomic DNA

SEQ ID NO: 128797 - DNA, 41 bp, Homo sapiens; identical to SEQ ID NO: 96975
  misc_feature 1..41: note = chr7:157624712-157624753
  misc_feature 1..41: note = Hypo
  source 1..41: mol_type = genomic DNA

SEQ ID NO: 128798 - DNA, 30 bp, Homo sapiens; identical to SEQ ID NO: 96976
  misc_feature 1..30: note = chr7:157626674-157626704
  misc_feature 1..30: note = Hypo
  source 1..30: mol_type = genomic DNA

SEQ ID NO: 128799 - DNA, 123 bp, Homo sapiens; identical to SEQ ID NO: 41615
  misc_feature 1..123: note = chr7:157633412-157633535
  misc_feature 1..123: note = Hypo
  source 1..123: mol_type = genomic DNA

SEQ ID NO: 128800 - DNA, 30 bp, Homo sapiens; identical to SEQ ID NO: 41616
  misc_feature 1..30: note = chr7:157642058-157642088
  misc_feature 1..30: note = Hypo
  source 1..30: mol_type = genomic DNA

SEQ ID NO: 128801 - DNA, 35 bp, Homo sapiens; identical to SEQ ID NO: 96979
  misc_feature 1..35: note = chr7:157645946-157645981
  misc_feature 1..35: note = Hypo
  source 1..35: mol_type = genomic DNA

SEQ ID NO: 128802 - DNA, 30 bp, Homo sapiens; identical to SEQ ID NO: 41617
  misc_feature 1..30: note = chr7:157654407-157654437
  misc_feature 1..30: note = Hypo
  source 1..30: mol_type = genomic DNA

SEQ ID NO: 128803 - DNA, 30 bp, Homo sapiens; identical to SEQ ID NO: 96981
  misc_feature 1..30: note = chr7:157655687-157655717
  misc_feature 1..30: note = Hypo
  source 1..30: mol_type = genomic DNA

SEQ ID NO: 128804 - DNA, 87 bp, Homo sapiens; identical to SEQ ID NO: 96982
  misc_feature 1..87: note = chr7:157656677-157656764
  misc_feature 1..87: note = Hypo
  source 1..87: mol_type = genomic DNA

SEQ ID NO: 128805 - DNA, 217 bp, Homo sapiens; identical to SEQ ID NO: 96983
  misc_feature 1..217: note = chr7:157659256-157659473
  misc_feature 1..217: note = Hypo
  source 1..217: mol_type = genomic DNA

SEQ ID NO: 128806 - DNA, 80 bp, Homo sapiens; identical to SEQ ID NO: 96984
  misc_feature 1..80: note = chr7:157660078-157660158
  misc_feature 1..80: note = Hypo
  source 1..80: mol_type = genomic DNA

SEQ ID NO: 128807 - DNA, 33 bp, Homo sapiens; identical to SEQ ID NO: 96985
  misc_feature 1..33: note = chr7:157690247-157690280
  misc_feature 1..33: note = Hypo
  source 1..33: mol_type = genomic DNA

SEQ ID NO: 128808 - DNA, 30 bp, Homo sapiens; identical to SEQ ID NO: 96986
  misc_feature 1..30: note = chr7:157695195-157695225
  misc_feature 1..30: note = Hypo
  source 1..30: mol_type = genomic DNA

SEQ ID NO: 128809 - DNA, 459 bp, Homo sapiens; identical to SEQ ID NO: 96987
  misc_feature 1..459: note = chr7:157702952-157703411
  misc_feature 1..459: note = Hypo
  source 1..459: mol_type = genomic DNA

SEQ ID NO: 128810 - DNA, 30 bp, Homo sapiens; identical to SEQ ID NO: 41622
  misc_feature 1..30: note = chr7:157718446-157718476
  misc_feature 1..30: note = Hypo
  source 1..30: mol_type = genomic DNA

SEQ ID NO: 128811 - DNA, 49 bp, Homo sapiens; identical to SEQ ID NO: 96989
  misc_feature 1..49: note = chr7:157722602-157722651
  misc_feature 1..49: note = Hypo
  source 1..49: mol_type = genomic DNA

SEQ ID NO: 128812 - DNA, 301 bp, Homo sapiens; identical to SEQ ID NO: 96990
  misc_feature 1..301: note = chr7:157776661-157776962
  misc_feature 1..301: note = Hypo
  source 1..301: mol_type = genomic DNA

SEQ ID NO: 128813 - DNA, 71 bp, Homo sapiens; identical to SEQ ID NO: 96991
  misc_feature 1..71: note = chr7:157778447-157778518
  misc_feature 1..71: note = Hypo
  source 1..71: mol_type = genomic DNA

SEQ ID NO: 128814 - DNA, 35 bp, Homo sapiens; identical to SEQ ID NO: 96992
  misc_feature 1..35: note = chr7:157793339-157793374
  misc_feature 1..35: note = Hypo
  source 1..35: mol_type = genomic DNA

SEQ ID NO: 128815 - DNA, 77 bp, Homo sapiens; identical to SEQ ID NO: 96993
  misc_feature 1..77: note = chr7:157793825-157793902
  misc_feature 1..77: note = Hypo
  source 1..77: mol_type = genomic DNA

SEQ ID NO: 128816 - DNA, 145 bp, Homo sapiens; identical to SEQ ID NO: 96994
  misc_feature 1..145: note = chr7:157794503-157794648
  misc_feature 1..145: note = Hypo
  source 1..145: mol_type = genomic DNA

SEQ ID NO: 128817 - DNA, 30 bp, Homo sapiens; identical to SEQ ID NO: 96995
  misc_feature 1..30: note = chr7:157795418-157795448
  misc_feature 1..30: note = Hypo
  source 1..30: mol_type = genomic DNA

SEQ ID NO: 128818 - DNA, 30 bp, Homo sapiens; identical to SEQ ID NO: 96996
  misc_feature 1..30: note = chr7:157853764-157853794
  misc_feature 1..30: note = Hypo
  source 1..30: mol_type = genomic DNA

SEQ ID NO: 128819 - DNA, 180 bp, Homo sapiens; identical to SEQ ID NO: 96997
  misc_feature 1..180: note = chr7:157877427-157877607
  misc_feature 1..180: note = Hypo
  source 1..180: mol_type = genomic DNA

SEQ ID NO: 128820 - DNA, 43 bp, Homo sapiens; identical to SEQ ID NO: 96998
  misc_feature 1..43: note = chr7:157886934-157886977
  misc_feature 1..43: note = Hypo
  source 1..43: mol_type = genomic DNA

SEQ ID NO: 128821 - DNA, 30 bp, Homo sapiens; identical to SEQ ID NO: 96999
  misc_feature 1..30: note = chr7:157890829-157890859
  misc_feature 1..30: note = Hypo
  source 1..30: mol_type = genomic DNA

SEQ ID NO: 128822 - DNA, 235 bp, Homo sapiens; identical to SEQ ID NO: 97000
  misc_feature 1..235: note = chr7:157891284-157891519
  misc_feature 1..235: note = Hypo
  source 1..235: mol_type = genomic DNA

SEQ ID NO: 128823 - DNA, 193 bp, Homo sapiens; identical to SEQ ID NO: 97001
  misc_feature 1..193: note = chr7:157932110-157932303
  misc_feature 1..193: note = Hypo
  source 1..193: mol_type = genomic DNA

SEQ ID NO: 128824 - DNA, 66 bp, Homo sapiens; identical to SEQ ID NO: 97002
  misc_feature 1..66: note = chr7:157934593-157934659
  misc_feature 1..66: note = Hypo
  source 1..66: mol_type = genomic DNA

SEQ ID NO: 128825 - DNA, 185 bp, Homo sapiens; identical to SEQ ID NO: 97003
  misc_feature 1..185: note = chr7:157955324-157955509
  misc_feature 1..185: note = Hypo
  source 1..185: mol_type = genomic DNA

SEQ ID NO: 128826 - DNA, 158 bp, Homo sapiens; identical to SEQ ID NO: 97004
  misc_feature 1..158: note = chr7:157956509-157956667
  misc_feature 1..158: note = Hypo
  source 1..158: mol_type = genomic DNA

SEQ ID NO: 128827 - DNA, 190 bp, Homo sapiens; identical to SEQ ID NO: 97005
  misc_feature 1..190: note = chr7:157958513-157958703
  misc_feature 1..190: note = Hypo
  source 1..190: mol_type = genomic DNA

SEQ ID NO: 128828 - DNA, 63 bp, Homo sapiens; identical to SEQ ID NO: 97006
  misc_feature 1..63: note = chr7:157984975-157985038
  misc_feature 1..63: note = Hypo
  source 1..63: mol_type = genomic DNA

SEQ ID NO: 128829 - DNA, 124 bp, Homo sapiens; identical to SEQ ID NO: 97007
  misc_feature 1..124: note = chr7:157987024-157987148
  misc_feature 1..124: note = Hypo
  source 1..124: mol_type = genomic DNA

SEQ ID NO: 128830 - DNA, 87 bp, Homo sapiens; identical to SEQ ID NO: 97008
  misc_feature 1..87: note = chr7:158037639-158037726
  misc_feature 1..87: note = Hypo
  source 1..87: mol_type = genomic DNA

SEQ ID NO: 128831 - DNA, 30 bp, Homo sapiens; identical to SEQ ID NO: 97009
  misc_feature 1..30: note = chr7:158039764-158039794
  misc_feature 1..30: note = Hypo
  source 1..30: mol_type = genomic DNA

SEQ ID NO: 128832 - DNA, 266 bp, Homo sapiens; identical to SEQ ID NO: 97010
  misc_feature 1..266: note = chr7:158040050-158040316
  misc_feature 1..266: note = Hypo
  source 1..266: mol_type = genomic DNA

SEQ ID NO: 128833 - DNA, 92 bp, Homo sapiens; identical to SEQ ID NO: 97011
  misc_feature 1..92: note = chr7:158046523-158046615
  misc_feature 1..92: note = Hypo
  source 1..92: mol_type = genomic DNA

SEQ ID NO: 128834 - DNA, 30 bp, Homo sapiens; identical to SEQ ID NO: 97012
  misc_feature 1..30: note = chr7:158054306-158054336
  misc_feature 1..30: note = Hypo
  source 1..30: mol_type = genomic DNA

SEQ ID NO: 128835 - DNA, 176 bp, Homo sapiens; identical to SEQ ID NO: 97013
  misc_feature 1..176: note = chr7:158059198-158059374
  misc_feature 1..176: note = Hypo
  source 1..176: mol_type = genomic DNA

SEQ ID NO: 128836 - DNA, 277 bp, Homo sapiens; identical to SEQ ID NO: 97014
  misc_feature 1..277: note = chr7:158059722-158059999
  misc_feature 1..277: note = Hypo
  source 1..277: mol_type = genomic DNA

SEQ ID NO: 128837 - DNA, 153 bp, Homo sapiens; identical to SEQ ID NO: 97015
  misc_feature 1..153: note = chr7:158065251-158065404
  misc_feature 1..153: note = Hypo
  source 1..153: mol_type = genomic DNA

SEQ ID NO: 128838 - DNA, 120 bp, Homo sapiens; identical to SEQ ID NO: 97016
  misc_feature 1..120: note = chr7:158066949-158067069
  misc_feature 1..120: note = Hypo
  source 1..120: mol_type = genomic DNA

SEQ ID NO: 128839 - DNA, 44 bp, Homo sapiens; identical to SEQ ID NO: 97017
  misc_feature 1..44: note = chr7:158075807-158075851
  misc_feature 1..44: note = Hypo
  source 1..44: mol_type = genomic DNA

SEQ ID NO: 128840 - DNA, 30 bp, Homo sapiens; identical to SEQ ID NO: 97018
  misc_feature 1..30: note = chr7:158103351-158103381
  misc_feature 1..30: note = Hypo
  source 1..30: mol_type = genomic DNA

SEQ ID NO: 128841 - DNA, 103 bp, Homo sapiens; identical to SEQ ID NO: 97019
  misc_feature 1..103: note = chr7:158113168-158113271
  misc_feature 1..103: note = Hypo
  source 1..103: mol_type = genomic DNA

SEQ ID NO: 128842 - DNA, 47 bp, Homo sapiens; identical to SEQ ID NO: 97020
  misc_feature 1..47: note = chr7:158144245-158144292
  misc_feature 1..47: note = Hypo
  source 1..47: mol_type = genomic DNA

SEQ ID NO: 128843 - DNA, 30 bp, Homo sapiens; identical to SEQ ID NO: 97021
  misc_feature 1..30: note = chr7:158167123-158167153
  misc_feature 1..30: note = Hypo
  source 1..30: mol_type = genomic DNA

SEQ ID NO: 128844 - DNA, 145 bp, Homo sapiens; identical to SEQ ID NO: 97022
  misc_feature 1..145: note = chr7:158187594-158187739
  misc_feature 1..145: note = Hypo
  source 1..145: mol_type = genomic DNA

SEQ ID NO: 128845 - DNA, 45 bp, Homo sapiens; identical to SEQ ID NO: 97023
  misc_feature 1..45: note = chr7:158188532-158188577
  misc_feature 1..45: note = Hypo
  source 1..45: mol_type = genomic DNA

SEQ ID NO: 128846 - DNA, 30 bp, Homo sapiens; identical to SEQ ID NO: 97024
  misc_feature 1..30: note = chr7:158207406-158207436
  misc_feature 1..30: note = Hypo
  source 1..30: mol_type = genomic DNA

SEQ ID NO: 128847 - DNA, 33 bp, Homo sapiens; identical to SEQ ID NO: 97025
  misc_feature 1..33: note = chr7:158246475-158246508
  misc_feature 1..33: note = Hypo
  source 1..33: mol_type = genomic DNA

SEQ ID NO: 128848 - DNA, 96 bp, Homo sapiens; identical to SEQ ID NO: 97026
  misc_feature 1..96: note = chr7:158249132-158249228
  misc_feature 1..96: note = Hypo
  source 1..96: mol_type = genomic DNA

SEQ ID NO: 128849 - DNA, 47 bp, Homo sapiens; identical to SEQ ID NO: 97027
  misc_feature 1..47: note = chr7:158277680-158277727
  misc_feature 1..47: note = Hypo
  source 1..47: mol_type = genomic DNA

SEQ ID NO: 128850 - DNA, 205 bp, Homo sapiens; identical to SEQ ID NO: 97028
  misc_feature 1..205: note = chr7:158282122-158282327
  misc_feature 1..205: note = Hypo
  source 1..205: mol_type = genomic DNA

SEQ ID NO: 128851 - DNA, 32 bp, Homo sapiens; identical to SEQ ID NO: 97029
  misc_feature 1..32: note = chr7:158282841-158282873
  misc_feature 1..32: note = Hypo
  source 1..32: mol_type = genomic DNA

SEQ ID NO: 128852 - DNA, 48 bp, Homo sapiens; identical to SEQ ID NO: 97030
  misc_feature 1..48: note = chr7:158283188-158283236
  misc_feature 1..48: note = Hypo
  source 1..48: mol_type = genomic DNA

SEQ ID NO: 128853 - DNA, 436 bp, Homo sapiens; identical to SEQ ID NO: 41640
  misc_feature 1..436: note = chr7:158301251-158301687
  misc_feature 1..436: note = Hypo
  source 1..436: mol_type = genomic DNA

SEQ ID NO: 128854 - DNA, 30 bp, Homo sapiens; identical to SEQ ID NO: 97032
  misc_feature 1..30: note = chr7:158319411-158319441
  misc_feature 1..30: note = Hypo
  source 1..30: mol_type = genomic DNA

SEQ ID NO: 128855 - DNA, 30 bp, Homo sapiens; identical to SEQ ID NO: 41641
  misc_feature 1..30: note = chr7:158332352-158332382
  misc_feature 1..30: note = Hypo
  source 1..30: mol_type = genomic DNA

SEQ ID NO: 128856 - DNA, 291 bp, Homo sapiens; identical to SEQ ID NO: 97034
  misc_feature 1..291: note = chr7:158349456-158349747
  misc_feature 1..291: note = Hypo
  source 1..291: mol_type = genomic DNA

SEQ ID NO: 128857 - DNA, 30 bp, Homo sapiens; identical to SEQ ID NO: 97035
  misc_feature 1..30: note = chr7:158355894-158355924
  misc_feature 1..30: note = Hypo
  source 1..30: mol_type = genomic DNA

SEQ ID NO: 128858 - DNA, 421 bp, Homo sapiens; identical to SEQ ID NO: 97036
  misc_feature 1..421: note = chr7:158379278-158379699
  misc_feature 1..421: note = Hyper
  source 1..421: mol_type = genomic DNA

SEQ ID NO: 128859 - DNA, 117 bp, Homo sapiens; identical to SEQ ID NO: 97037
  misc_feature 1..117: note = chr7:158380279-158380396
  misc_feature 1..117: note = Hyper
  source 1..117: mol_type = genomic DNA

SEQ ID NO: 128860 - DNA, 401 bp, Homo sapiens; identical to SEQ ID NO: 97038
  misc_feature 1..401: note = chr7:158380813-158381214
  misc_feature 1..401: note = Hyper
  source 1..401: mol_type = genomic DNA

SEQ ID NO: 128861 - DNA, 30 bp, Homo sapiens; identical to SEQ ID NO: 97039
  misc_feature 1..30: note = chr7:158450990-158451020
  misc_feature 1..30: note = Hypo
  source 1..30: mol_type = genomic DNA

SEQ ID NO: 128862 - DNA, 30 bp, Homo sapiens; identical to SEQ ID NO: 97040
  misc_feature 1..30: note = chr7:158522269-158522299
  misc_feature 1..30: note = Hypo
  source 1..30: mol_type = genomic DNA

SEQ ID NO: 128863 - DNA, 240 bp, Homo sapiens; identical to SEQ ID NO: 41643
  misc_feature 1..240: note = chr7:158550099-158550339
  misc_feature 1..240: note = Hypo
  source 1..240: mol_type = genomic DNA

SEQ ID NO: 128864 - DNA, 30 bp, Homo sapiens; identical to SEQ ID NO: 41644
  misc_feature 1..30: note = chr7:158564374-158564404
  misc_feature 1..30: note = Hypo
  source 1..30: mol_type = genomic DNA

SEQ ID NO: 128865 - DNA, 18 bp, Homo sapiens
  misc_feature 1..18: note = chr7:158594958-158594976
  misc_feature 1..18: note = Hypo
  source 1..18: mol_type = genomic DNA
tccatgtcctatgcacga

SEQ ID NO: 128866 - DNA, 277 bp, Homo sapiens; identical to SEQ ID NO: 97044
  misc_feature 1..277: note = chr7:158766828-158767105
  misc_feature 1..277: note = Hypo
  source 1..277: mol_type = genomic DNA

SEQ ID NO: 128867 - DNA, 139 bp, Homo sapiens; identical to SEQ ID NO: 97045
  misc_feature 1..139: note = chr7:158788416-158788555
  misc_feature 1..139: note = Hypo
  source 1..139: mol_type = genomic DNA

SEQ ID NO: 128868 - DNA, 30 bp, Homo sapiens; identical to SEQ ID NO: 97046
  misc_feature 1..30: note = chr7:158815031-158815061
  misc_feature 1..30: note = Hypo
  source 1..30: mol_type = genomic DNA

SEQ ID NO: 128869 - DNA, 30 bp, Homo sapiens; identical to SEQ ID NO: 97047
  misc_feature 1..30: note = chr7:158817049-158817079
  misc_feature 1..30: note = Hypo
  source 1..30: mol_type = genomic DNA

SEQ ID NO: 128870 - DNA, 356 bp, Homo sapiens; identical to SEQ ID NO: 97048
  misc_feature 1..356: note = chr7:158823309-158823665
  misc_feature 1..356: note = Hyper
  source 1..356: mol_type = genomic DNA

SEQ ID NO: 128871 - DNA, 93 bp, Homo sapiens; identical to SEQ ID NO: 97049
  misc_feature 1..93: note = chr7:158857187-158857280
  misc_feature 1..93: note = Hypo
  source 1..93: mol_type = genomic DNA

SEQ ID NO: 128872 - DNA, 77 bp, Homo sapiens; identical to SEQ ID NO: 97050
  misc_feature 1..77: note = chr7:158868410-158868487
  misc_feature 1..77: note = Hypo
  source 1..77: mol_type = genomic DNA

SEQ ID NO: 128873 - DNA, 203 bp, Homo sapiens; identical to SEQ ID NO: 97051
  misc_feature 1..203: note = chr7:158933031-158933234
  misc_feature 1..203: note = Hypo
  source 1..203: mol_type = genomic DNA

SEQ ID NO: 128874 - DNA, 1473 bp, Homo sapiens
  misc_feature 1..1473: note = chr7:158936522-158937995
  misc_feature 1..1473: note = Hyper
  source 1..1473: mol_type = genomic DNA
tactttccaaggacccgctccgcaaagcgcccaccctcgagggaggaaagccgagctgcgcctccgcgcaaggccagggagtgtggctcgagccccgctgcagaccgggcgtcgccggttaatcaatgacactgtcgggtcagcagcgcagcctcccagctgcggaggggccgcggatcgatccagacctgcctcggctgcgacgcgcacgaaaaccgcgcgcaccgcaaacccgcttcagtctccaagaggaaagcaagaaacaaggctcgggtttttttctttcttttttctttcctttttttttaaggttcacagagggaataattcagaactccatgtgcgaaggcacttaatcaacaaacttatgagcagttagttcctccagtgcccttgggaaaaagcaactatttccaaaaggaaactttatttaaccgacgccacgtccccccgacactaaaactaaccagtaagtacagggagggaccgagaggcatctgcggccaacgccaaccccgatctccccgtgaaacgcgcagcccgcgcaggcgcccgcagctcccagctcccgggacggccccgaacgagctcatcgttgacgcgtccaggaagaaacgatcccgtttccagcaaaccccggacggtggggcgcggggaagggcgcaggcagcctcccaacccgagtcccgcaacccggcgggaccggagctcagcgcttcacgctctccgggaggaagctccggaccccgggcgaccccgctccctctcccggaccccgcccgcgctccagcacccgggaggaaggcgaagaccggcgggaggagcgctcttctcggaaggggagaaccgggtccgaggcgccgtggggcgggggtcgcgggcgcactcacgggggcgagcagccagcaggtcagcagcgcgggaggcagcagcgtccgcatcccgagctcagcgtgccgggggccgcccagcgcccgccgcctccgtcctaggtccccgcggttccgccgcctccagcatgggccgggagcgagtgcgcggagacctcgggccccgcagctgtagccgagcgcccgagcgcgggggccgccccctccgtcccggcagctggagcgcgctcaatgcacgcccgtcccccacgcgccccgccgctccgccccccgcccctgtccccgccccgcgctgccccaatcctcgtctccctcctcccccgagaacccccgctccgcgcccctcctcaccgccccccacttccccttccgctgcgccccgcgccctctcctcgcccctgggctctctgtccccgccgcgcgcgctccctctggtctcctcgacccccccagcctctctctccgttctcctcccctcttccctggcccacgcccccctcccggccgcgcctccccgatctgtgggcggaggggctgggaagcggggtgctcagtgcgcgcccggctccgagtagagagaact

SEQ ID NO: 128875 - DNA, 223 bp, Homo sapiens; identical to SEQ ID NO: 97056
  misc_feature 1..223: note = chr7:158938210-158938433
  misc_feature 1..223: note = Hyper
  source 1..223: mol_type = genomic DNA

SEQ ID NO: 128876 - DNA, 108 bp, Homo sapiens; identical to SEQ ID NO: 97057
  misc_feature 1..108: note = chr7:158948149-158948257
  misc_feature 1..108: note = Hypo
  source 1..108: mol_type = genomic DNA

SEQ ID NO: 128877 - DNA, 30 bp, Homo sapiens; identical to SEQ ID NO: 97058
  misc_feature 1..30: note = chr7:158950620-158950650
  misc_feature 1..30: note = Hypo
  source 1..30: mol_type = genomic DNA

SEQ ID NO: 128878 - DNA, 549 bp, Homo sapiens; identical to SEQ ID NO: 97059
  misc_feature 1..549: note = chr7:158963388-158963937
  misc_feature 1..549: note = Hypo
  source 1..549: mol_type = genomic DNA

SEQ ID NO: 128879 - DNA, 43 bp, Homo sapiens; identical to SEQ ID NO: 97060
  misc_feature 1..43: note = chr7:159023728-159023771
  misc_feature 1..43: note = Hypo
  source 1..43: mol_type = genomic DNA

SEQ ID NO: 128880 - DNA, 128 bp, Homo sapiens; identical to SEQ ID NO: 41648
  misc_feature 1..128: note = chr8:245097-245225
  misc_feature 1..128: note = Hypo
  source 1..128: mol_type = genomic DNA

SEQ ID NO: 128881 - DNA, 38 bp, Homo sapiens; identical to SEQ ID NO: 99274
  misc_feature 1..38: note = chr8:273114-273152
  misc_feature 1..38: note = Hypo
  source 1..38: mol_type = genomic DNA

SEQ ID NO: 128882 - DNA, 129 bp, Homo sapiens; identical to SEQ ID NO: 99294
  misc_feature 1..129: note = chr8:299672-299801
  misc_feature 1..129: note = Hypo
  source 1..129: mol_type = genomic DNA

SEQ ID NO: 128883 - DNA, 30 bp, Homo sapiens; identical to SEQ ID NO: 99304
  misc_feature 1..30: note = chr8:308732-308762
  misc_feature 1..30: note = Hypo
  source 1..30: mol_type = genomic DNA

SEQ ID NO: 128884 - DNA, 252 bp, Homo sapiens
  misc_feature 1..252: note = chr8:494235-494487
  misc_feature 1..252: note = Hyper
  source 1..252: mol_type = genomic DNA
cgggacgcgagcacccggcgtggacctctgcgtcccgggcccacgacgcccgcgccgcggggtgcgcgcactgcgtccccgctctcctgggactgcgccccgagtaacacgtgcagggggcactgggtcccctgcaagcggcgagaacgccggcagccctggccagttaagcggggagtgggtccacgcggaccacagcggcaactcagcccaggacgagcctcgggtcaagttctccgactccgcactcgg

SEQ ID NO: 128885 - DNA, 32 bp, Homo sapiens
  misc_feature 1..32: note = chr8:494838-494870
  misc_feature 1..32: note = Hyper
  source 1..32: mol_type = genomic DNA
gcggctcctgcgggacgcgggcccagtgggcc

SEQ ID NO: 128886 - DNA, 298 bp, Homo sapiens
  misc_feature 1..298: note = chr8:495703-496001
  misc_feature 1..298: note = Hyper
  source 1..298: mol_type = genomic DNA
gccgggaggaagcctcgcccagccctggtgggcggtggggccgctggggcctggggcgccgcgggctcggcccggactgacggcggtggggggcggggatggggccgtggtgccgggccgcgcagaacccttgggacccccgcggcgcccaggttggggctcagggcccggagaacgttttcccgcgtggctatggctttgtcagaatcaggagcgggagaggcgcccacagattcctgagggcagaaccgcctggttcccaggccgaaaggagccggcgaggcgacccccgatcccg

SEQ ID NO: 128887 - DNA, 39 bp, Homo sapiens; identical to SEQ ID NO: 99574
  misc_feature 1..39: note = chr8:566435-566474
  misc_feature 1..39: note = Hypo
  source 1..39: mol_type = genomic DNA

SEQ ID NO: 128888 - DNA, 178 bp, Homo sapiens; identical to SEQ ID NO: 99617
  misc_feature 1..178: note = chr8:591505-591683
  misc_feature 1..178: note = Hypo
  source 1..178: mol_type = genomic DNA

SEQ ID NO: 128889 - DNA, 36 bp, Homo sapiens; identical to SEQ ID NO: 99618
  misc_feature 1..36: note = chr8:592946-592982
  misc_feature 1..36: note = Hypo
  source 1..36: mol_type = genomic DNA

SEQ ID NO: 128890 - DNA, 96 bp, Homo sapiens; identical to SEQ ID NO: 99619
  misc_feature 1..96: note = chr8:593203-593299
  misc_feature 1..96: note = Hypo
  source 1..96: mol_type = genomic DNA

SEQ ID NO: 128891 - DNA, 168 bp, Homo sapiens; identical to SEQ ID NO: 99654
  misc_feature 1..168: note = chr8:636372-636540
  misc_feature 1..168: note = Hypo
  source 1..168: mol_type = genomic DNA

SEQ ID NO: 128892 - DNA, 167 bp, Homo sapiens; identical to SEQ ID NO: 99660
  misc_feature 1..167: note = chr8:644635-644802
  misc_feature 1..167: note = Hypo
  source 1..167: mol_type = genomic DNA

SEQ ID NO: 128893 - DNA, 41 bp, Homo sapiens; identical to SEQ ID NO: 99664
  misc_feature 1..41: note = chr8:647337-647378
  misc_feature 1..41: note = Hypo
  source 1..41: mol_type = genomic DNA

SEQ ID NO: 128894 - DNA, 2692 bp, Homo sapiens
  misc_feature 1..2692: note = chr8:686714-689406
  misc_feature 1..2692: note = Hyper
  source 1..2692: mol_type = genomic DNA
tatgcggtttgttttcgcatcttttacctcatttaaatgccgtagccatgcaggtggaaagcagaaatccatttctgcgtttatgttaaactggggctgagagacttgcccagggtcggtgaccgcccagggatccccataccagcgcgtctagctcccgcgttccgatcccggaagggaaaacccatgatcctggcgagggtccgtccacacgtggccagggtggctgatcttcccggctgctgtggttgtcaacaccacttctccggatcgattttcccttttcctcggctctgtcgtccatacgccactcacagcaaacccaggcggcgggccccctccgagggcgctccttgcgtccggacccaggttctcggggcgccccccggtgggtccccgcgaagccgccgccgcacaccttcctcagcgtagcccgccagtggaaaccgggggaggttctgcctccagcacccaagcggcggccgcacctcgcagtgagaccctcgcaagcgcccgcgcctccctcgccccgcgtcccctctgccccgcgagcccccctgggcgccgagccgactcgaacccgagcgcgagtcccgcgcacaaacgcgccggcgcgtctctaacagcggtccagaaaggctgaccctgcccgggggcgacgggtgtgaccgggtcccccgctaactttcgggcgcggtgagcgtcgcctgcgcgcgccgcggtggaggccgctgctttcccgccgggagcccggcacagtccccgggtgacccgcgcgccccgcgcaacagttggagccgggctgcccgcgcgctccccaagccgggcccttccccagatgcagccgcgcgccggccgccccccagtgcgccggtgcctccctgggcgccgagtgcgcaggcgccggccgtgaagaccgaccgtgcgccgggctcgagcgcggtctgagcgcgcggcgcctgcggcggcgaacggacggacggaccgcggacggacgtactgaccccaacccgcgagccccgggagccgtcggtctgaggaggggccgcttcgccatgtcgccccgcacctgctgagcccggagcgtccgaggatgtccgcgctgaggaaggtgcgagccgccgggggctgccgggagccgggcgcggggctccgagagccgtcgaggcggggagggcgcggtgtgtcggacccgcggggacgccccgagggcgtcagggttgggggcgggggcgagcgggggtcgtgccgcccgccggggccggagcgctggggaccccagggacagcctgtgctcgggggtcgcgcgttgcgctcctcgccgggctccgcgcatccctggccgcgctcgggggtgccgggaccctgggctccgggggtgcgggagcgcacggggccgcggaggtgtgaaattctccgctctgcctgcccggggtggagggggcaaagcctggggggtgccggcgcgccaggggctacgcgcctagctccggtggggcagctgcgagcgagtgggggcggcgggcagcagactgcatccccctccccccaagcccgggtggaaacgccgacggggactgggaatgaatgaagggtgccgggctgggctgcgcgcacgggggctcgcgggggcgggggcgaccaggatggggcccttgtgccgggcagcagcggctgccgagaccaggcggagtggagggtgcgcgcagcgagggggtggccgccgcccggctctccaagtgcgagcgaggagctcggggtcttttttaggggtggttgctaagcgaggcgctacccagcgcagggttttgtaactaagcctcccccggcagcggctgttgctgtctccggctccttcgctaacgattgcaggagaaataatgaggatgtaattattacagccctgcgcggagggctggggggcggcggacgcgggctcctctgcctgcgcgcccaggtggggctgggctgggctgggctgggctgggctggactggacgcctctccccgcccggccctccctcagcgcgcggcgtgtgcggtgcccgaggcttcggagcaggctggacctgggaacccggggaggggcctggaggagagatagctgggcgaggtgggcgccggcgagaaggcggagcccccggacagcgtaggttcgcaggtggagagcggacgcgggggcgagggtgcgcggcgggtctgcgatgcgcgtcggaaactcgcggcccccggtcccggccctgcgcgcttggagcccgggtccttccagcccctgcgcgacgccgccgccgccgccgccggtgaatggcgatcccggccacggcctggaattggaaattcgtgacttgtcggcggccccggtcttctatcgattaaagataaagcgatcagcagtgaatttatccttcgtgtggatgaactcggccagcccgggctgtggggggtttgggaactgtaaatattctccaaagcgccgccgcttctcccgtcttcccggactcgaggctggaggcagctccggcgacgcgaaggggggtaccccccggagaggtcgggcctggggcgcggcggacagagacccggtcccagagcctggcggagcccgacaatccgccctgtcaggaggaatctcatcaacagcccgtgaattaattgtccttgcagttgggaaataacccggtacctcggcgta

SEQ ID NO: 128895 - DNA, 30 bp, Homo sapiens; identical to SEQ ID NO: 41650
  misc_feature 1..30: note = chr8:700159-700189
  misc_feature 1..30: note = Hypo
  source 1..30: mol_type = genomic DNA

SEQ ID NO: 128896 - DNA, 30 bp, Homo sapiens; identical to SEQ ID NO: 99817
  misc_feature 1..30: note = chr8:751817-751847
  misc_feature 1..30: note = Hypo
  source 1..30: mol_type = genomic DNA

SEQ ID NO: 128897 - DNA, 30 bp, Homo sapiens; identical to SEQ ID NO: 99841
  misc_feature 1..30: note = chr8:787176-787206
  misc_feature 1..30: note = Hypo
  source 1..30: mol_type = genomic DNA

SEQ ID NO: 128898 - DNA, 93 bp, Homo sapiens; identical to SEQ ID NO: 99842
  misc_feature 1..93: note = chr8:790385-790478
  misc_feature 1..93: note = Hypo
  source 1..93: mol_type = genomic DNA

SEQ ID NO: 128899 - DNA, 145 bp, Homo sapiens; identical to SEQ ID NO: 99880
  misc_feature 1..145: note = chr8:852161-852306
  misc_feature 1..145: note = Hypo
  source 1..145: mol_type = genomic DNA

SEQ ID NO: 128900 - DNA, 134 bp, Homo sapiens; identical to SEQ ID NO: 99881
  misc_feature 1..134: note = chr8:853984-854118
  misc_feature 1..134: note = Hypo
  source 1..134: mol_type = genomic DNA

SEQ ID NO: 128901 - DNA, 105 bp, Homo sapiens; identical to SEQ ID NO: 99882
  misc_feature 1..105: note = chr8:854712-854817
  misc_feature 1..105: note = Hypo
  source 1..105: mol_type = genomic DNA

SEQ ID NO: 128902 - DNA, 30 bp, Homo sapiens; identical to SEQ ID NO: 99903
  misc_feature 1..30: note = chr8:865633-865663
  misc_feature 1..30: note = Hypo
  source 1..30: mol_type = genomic DNA

SEQ ID NO: 128903 - DNA, 46 bp, Homo sapiens; identical to SEQ ID NO: 99917
  misc_feature 1..46: note = chr8:889984-890030
  misc_feature 1..46: note = Hypo
  source 1..46: mol_type = genomic DNA

SEQ ID NO: 128904 - DNA, 32 bp, Homo sapiens; identical to SEQ ID NO: 99923
  misc_feature 1..32: note = chr8:898037-898069
  misc_feature 1..32: note = Hypo
  source 1..32: mol_type = genomic DNA

SEQ ID NO: 128905 - DNA, 30 bp, Homo sapiens; identical to SEQ ID NO: 99935
  misc_feature 1..30: note = chr8:913030-913060
  misc_feature 1..30: note = Hypo
  source 1..30: mol_type = genomic DNA

SEQ ID NO: 128906 - DNA, 30 bp, Homo sapiens; identical to SEQ ID NO: 99938
  misc_feature 1..30: note = chr8:914330-914360
  misc_feature 1..30: note = Hypo
  source 1..30: mol_type = genomic DNA

SEQ ID NO: 128907 - DNA, 29 bp, Homo sapiens
  misc_feature 1..29: note = chr8:914936-914965
  misc_feature 1..29: note = Hypo
  source 1..29: mol_type = genomic DNA
tcgccaccgcacacacggctcctgagccc

SEQ ID NO: 128908 - DNA, 78 bp, Homo sapiens; identical to SEQ ID NO: 99967
  misc_feature 1..78: note = chr8:956346-956424
  misc_feature 1..78: note = Hypo
  source 1..78: mol_type = genomic DNA

SEQ ID NO: 128909 - DNA, 33 bp, Homo sapiens; identical to SEQ ID NO: 99975
  misc_feature 1..33: note = chr8:957089-957122
  misc_feature 1..33: note = Hypo
  source 1..33: mol_type = genomic DNA

SEQ ID NO: 128910 - DNA, 137 bp, Homo sapiens; identical to SEQ ID NO: 99984
  misc_feature 1..137: note = chr8:962438-962575
  misc_feature 1..137: note = Hypo
  source 1..137: mol_type = genomic DNA

SEQ ID NO: 128911 - DNA, 30 bp, Homo sapiens; identical to SEQ ID NO: 100009
  misc_feature 1..30: note = chr8:972233-972263
  misc_feature 1..30: note = Hypo
  source 1..30: mol_type = genomic DNA

SEQ ID NO: 128912 - DNA, 145 bp, Homo sapiens; identical to SEQ ID NO: 41655
  misc_feature 1..145: note = chr8:972705-972850
  misc_feature 1..145: note = Hypo
  source 1..145: mol_type = genomic DNA

SEQ ID NO: 128913 - DNA, 30 bp, Homo sapiens; identical to SEQ ID NO: 100019
  misc_feature 1..30: note = chr8:975257-975287
  misc_feature 1..30: note = Hypo
  source 1..30: mol_type = genomic DNA

SEQ ID NO: 128914 - DNA, 126 bp, Homo sapiens; identical to SEQ ID NO: 41656
  misc_feature 1..126: note = chr8:976259-976385
  misc_feature 1..126: note = Hypo
  source 1..126: mol_type = genomic DNA

SEQ ID NO: 128915 - DNA, 180 bp, Homo sapiens; identical to SEQ ID NO: 100031
  misc_feature 1..180: note = chr8:977877-978057
  misc_feature 1..180: note = Hypo
  source 1..180: mol_type = genomic DNA

SEQ ID NO: 128916 - DNA, 30 bp, Homo sapiens; identical to SEQ ID NO: 100039
  misc_feature 1..30: note = chr8:987146-987176
  misc_feature 1..30: note = Hypo
  source 1..30: mol_type = genomic DNA

SEQ ID NO: 128917 - DNA, 44 bp, Homo sapiens; identical to SEQ ID NO: 98319
  misc_feature 1..44: note = chr8:1000543-1000587
  misc_feature 1..44: note = Hypo
  source 1..44: mol_type = genomic DNA

SEQ ID NO: 128918 - DNA, 30 bp, Homo sapiens; identical to SEQ ID NO: 98328
  misc_feature 1..30: note = chr8:1010325-1010355
  misc_feature 1..30: note = Hypo
  source 1..30: mol_type = genomic DNA

SEQ ID NO: 128919 - DNA, 207 bp, Homo sapiens; identical to SEQ ID NO: 98372
  misc_feature 1..207: note = chr8:1043858-1044065
  misc_feature 1..207: note = Hypo
  source 1..207: mol_type = genomic DNA

SEQ ID NO: 128920 - DNA, 246 bp, Homo sapiens; identical to SEQ ID NO: 98377
  misc_feature 1..246: note = chr8:1048526-1048772
  misc_feature 1..246: note = Hypo
  source 1..246: mol_type = genomic DNA

SEQ ID NO: 128921 - DNA, 140 bp, Homo sapiens; identical to SEQ ID NO: 98379
  misc_feature 1..140: note = chr8:1051534-1051674
  misc_feature 1..140: note = Hypo
  source 1..140: mol_type = genomic DNA

SEQ ID NO: 128922 - DNA, 30 bp, Homo sapiens; identical to SEQ ID NO: 98384
  misc_feature 1..30: note = chr8:1053744-1053774
  misc_feature 1..30: note = Hypo
  source 1..30: mol_type = genomic DNA

SEQ ID NO: 128923 - DNA, 41 bp, Homo sapiens; identical to SEQ ID NO: 98404
  misc_feature 1..41: note = chr8:1060967-1061008
  misc_feature 1..41: note = Hypo
  source 1..41: mol_type = genomic DNA

SEQ ID NO: 128924 - DNA, 53 bp, Homo sapiens; identical to SEQ ID NO: 41660
  misc_feature 1..53: note = chr8:1066123-1066176
  misc_feature 1..53: note = Hypo
  source 1..53: mol_type = genomic DNA

SEQ ID NO: 128925 - DNA, 50 bp, Homo sapiens; identical to SEQ ID NO: 98430
  misc_feature 1..50: note = chr8:1085553-1085603
  misc_feature 1..50: note = Hypo
  source 1..50: mol_type = genomic DNA

SEQ ID NO: 128926 - DNA, 30 bp, Homo sapiens; identical to SEQ ID NO: 98443
  misc_feature 1..30: note = chr8:1088028-1088058
  misc_feature 1..30: note = Hypo
  source 1..30: mol_type = genomic DNA

SEQ ID NO: 128927 - DNA, 30 bp, Homo sapiens; identical to SEQ ID NO: 98471
  misc_feature 1..30: note = chr8:1108569-1108599
  misc_feature 1..30: note = Hypo
  source 1..30: mol_type = genomic DNA

SEQ ID NO: 128928 - DNA, 43 bp, Homo sapiens; identical to SEQ ID NO: 98492
  misc_feature 1..43: note = chr8:1133089-1133132
  misc_feature 1..43: note = Hypo
  source 1..43: mol_type = genomic DNA

SEQ ID NO: 128929 - DNA, 30 bp, Homo sapiens; identical to SEQ ID NO: 98493
  misc_feature 1..30: note = chr8:1134528-1134558
  misc_feature 1..30: note = Hypo
  source 1..30: mol_type = genomic DNA

SEQ ID NO: 128930 - DNA, 56 bp, Homo sapiens; identical to SEQ ID NO: 98494
  misc_feature 1..56: note = chr8:1136167-1136223
  misc_feature 1..56: note = Hypo
  source 1..56: mol_type = genomic DNA

SEQ ID NO: 128931 - DNA, 30 bp, Homo sapiens; identical to SEQ ID NO: 98495
  misc_feature 1..30: note = chr8:1136428-1136458
  misc_feature 1..30: note = Hypo
  source 1..30: mol_type = genomic DNA

SEQ ID NO: 128932 - DNA, 139 bp, Homo sapiens; identical to SEQ ID NO: 98496
  misc_feature 1..139: note = chr8:1137213-1137352
  misc_feature 1..139: note = Hypo
  source 1..139: mol_type = genomic DNA

SEQ ID NO: 128933 - DNA, 112 bp, Homo sapiens; identical to SEQ ID NO: 98497
  misc_feature 1..112: note = chr8:1139159-1139271
  misc_feature 1..112: note = Hypo
  source 1..112: mol_type = genomic DNA

SEQ ID NO: 128934 - DNA, 37 bp, Homo sapiens; identical to SEQ ID NO: 98498
  misc_feature 1..37: note = chr8:1140563-1140600
  misc_feature 1..37: note = Hypo
  source 1..37: mol_type = genomic DNA

SEQ ID NO: 128935 - DNA, 30 bp, Homo sapiens; identical to SEQ ID NO: 98507
  misc_feature 1..30: note = chr8:1148027-1148057
  misc_feature 1..30: note = Hypo
  source 1..30: mol_type = genomic DNA

SEQ ID NO: 128936 - DNA, 95 bp, Homo sapiens; identical to SEQ ID NO: 98510
  misc_feature 1..95: note = chr8:1151094-1151189
  misc_feature 1..95: note = Hypo
  source 1..95: mol_type = genomic DNA

SEQ ID NO: 128937 - DNA, 136 bp, Homo sapiens; identical to SEQ ID NO: 98511
  misc_feature 1..136: note = chr8:1152943-1153079
  misc_feature 1..136: note = Hypo
  source 1..136: mol_type = genomic DNA

SEQ ID NO: 128938 - DNA, 118 bp, Homo sapiens; identical to SEQ ID NO: 41667
  misc_feature 1..118: note = chr8:1153298-1153416
  misc_feature 1..118: note = Hypo
  source 1..118: mol_type = genomic DNA

SEQ ID NO: 128939 - DNA, 172 bp, Homo sapiens; identical to SEQ ID NO: 98547
  misc_feature 1..172: note = chr8:1184672-1184844
  misc_feature 1..172: note = Hypo
  source 1..172: mol_type = genomic DNA

SEQ ID NO: 128940 - DNA, 300 bp, Homo sapiens; identical to SEQ ID NO: 98551
  misc_feature 1..300: note = chr8:1201984-1202284
  misc_feature 1..300: note = Hypo
  source 1..300: mol_type = genomic DNA

SEQ ID NO: 128941 - DNA, 144 bp, Homo sapiens; identical to SEQ ID NO: 98553
  misc_feature 1..144: note = chr8:1202638-1202782
  misc_feature 1..144: note = Hypo
  source 1..144: mol_type = genomic DNA

SEQ ID NO: 128942 - DNA, 30 bp, Homo sapiens; identical to SEQ ID NO: 98555
  misc_feature 1..30: note = chr8:1203228-1203258
  misc_feature 1..30: note = Hypo
  source 1..30: mol_type = genomic DNA

SEQ ID NO: 128943 - DNA, 30 bp, Homo sapiens; identical to SEQ ID NO: 98559
  misc_feature 1..30: note = chr8:1204827-1204857
  misc_feature 1..30: note = Hypo
  source 1..30: mol_type = genomic DNA

SEQ ID NO: 128944 - DNA, 198 bp, Homo sapiens; identical to SEQ ID NO: 98565
  misc_feature 1..198: note = chr8:1209060-1209258
  misc_feature 1..198: note = Hypo
  source 1..198: mol_type = genomic DNA

SEQ ID NO: 128945 - DNA, 30 bp, Homo sapiens; identical to SEQ ID NO: 98585
  misc_feature 1..30: note = chr8:1219311-1219341
  misc_feature 1..30: note = Hypo
  source 1..30: mol_type = genomic DNA

SEQ ID NO: 128946 - DNA, 447 bp, Homo sapiens; identical to SEQ ID NO: 98608
  misc_feature 1..447: note = chr8:1246426-1246873
  misc_feature 1..447: note = Hypo
  source 1..447: mol_type = genomic DNA

SEQ ID NO: 128947 - DNA, 30 bp, Homo sapiens; identical to SEQ ID NO: 98610
  misc_feature 1..30: note = chr8:1251266-1251296
  misc_feature 1..30: note = Hypo
  source 1..30: mol_type = genomic DNA

SEQ ID NO: 128948 - DNA, 70 bp, Homo sapiens; identical to SEQ ID NO: 98611
  misc_feature 1..70: note = chr8:1251700-1251770
  misc_feature 1..70: note = Hypo
  source 1..70: mol_type = genomic DNA

SEQ ID NO: 128949 - DNA, 385 bp, Homo sapiens; identical to SEQ ID NO: 98632
  misc_feature 1..385: note = chr8:1269154-1269539
  misc_feature 1..385: note = Hypo
  source 1..385: mol_type = genomic DNA

SEQ ID NO: 128950 - DNA, 112 bp, Homo sapiens; identical to SEQ ID NO: 98636
  misc_feature 1..112: note = chr8:1276830-1276942
  misc_feature 1..112: note = Hypo
  source 1..112: mol_type = genomic DNA

SEQ ID NO: 128951 - DNA, 30 bp, Homo sapiens; identical to SEQ ID NO: 98638
  misc_feature 1..30: note = chr8:1279525-1279555
  misc_feature 1..30: note = Hypo
  source 1..30: mol_type = genomic DNA

SEQ ID NO: 128952 - DNA, 42 bp, Homo sapiens; identical to SEQ ID NO: 41671
  misc_feature 1..42: note = chr8:1281668-1281710
  misc_feature 1..42: note = Hypo
  source 1..42: mol_type = genomic DNA

SEQ ID NO: 128953 - DNA, 45 bp, Homo sapiens; identical to SEQ ID NO: 98644
  misc_feature 1..45: note = chr8:1284619-1284664
  misc_feature 1..45: note = Hypo
  source 1..45: mol_type = genomic DNA

SEQ ID NO: 128954 - DNA, 30 bp, Homo sapiens; identical to SEQ ID NO: 98654
  misc_feature 1..30: note = chr8:1290508-1290538
  misc_feature 1..30: note = Hypo
  source 1..30: mol_type = genomic DNA

SEQ ID NO: 128955 - DNA, 162 bp, Homo sapiens; identical to SEQ ID NO: 98667
  misc_feature 1..162: note = chr8:1302664-1302826
  misc_feature 1..162: note = Hypo
  source 1..162: mol_type = genomic DNA

SEQ ID NO: 128956 - DNA, 30 bp, Homo sapiens; identical to SEQ ID NO: 41673
  misc_feature 1..30: note = chr8:1303386-1303416
  misc_feature 1..30: note = Hypo
  source 1..30: mol_type = genomic DNA

SEQ ID NO: 128957 - DNA, 30 bp, Homo sapiens; identical to SEQ ID NO: 98675
  misc_feature 1..30: note = chr8:1305031-1305061
  misc_feature 1..30: note = Hypo
  source 1..30: mol_type = genomic DNA

SEQ ID NO: 128958 - DNA, 75 bp, Homo sapiens; identical to SEQ ID NO: 98677
  misc_feature 1..75: note = chr8:1306799-1306874
  misc_feature 1..75: note = Hypo
  source 1..75: mol_type = genomic DNA

SEQ ID NO: 128959 - DNA, 142 bp, Homo sapiens; identical to SEQ ID NO: 98678
  misc_feature 1..142: note = chr8:1307773-1307915
  misc_feature 1..142: note = Hypo
  source 1..142: mol_type = genomic DNA

SEQ ID NO: 128960 - DNA, 47 bp, Homo sapiens; identical to SEQ ID NO: 98679
  misc_feature 1..47: note = chr8:1308321-1308368
  misc_feature 1..47: note = Hypo
  source 1..47: mol_type = genomic DNA

SEQ ID NO: 128961 - DNA, 30 bp, Homo sapiens; identical to SEQ ID NO: 98691
  misc_feature 1..30: note = chr8:1326091-1326121
  misc_feature 1..30: note = Hypo
  source 1..30: mol_type = genomic DNA

SEQ ID NO: 128962 - DNA, 52 bp, Homo sapiens; identical to SEQ ID NO: 98692
  misc_feature 1..52: note = chr8:1326776-1326828
  misc_feature 1..52: note = Hypo
  source 1..52: mol_type = genomic DNA

SEQ ID NO: 128963 - DNA, 30 bp, Homo sapiens; identical to SEQ ID NO: 98693
  misc_feature 1..30: note = chr8:1327435-1327465
  misc_feature 1..30: note = Hypo
  source 1..30: mol_type = genomic DNA

SEQ ID NO: 128964 - DNA, 30 bp, Homo sapiens; identical to SEQ ID NO: 41675
  misc_feature 1..30: note = chr8:1340176-1340206
  misc_feature 1..30: note = Hypo
  source 1..30: mol_type = genomic DNA

SEQ ID NO: 128965 - DNA, 89 bp, Homo sapiens; identical to SEQ ID NO: 98732
  misc_feature 1..89: note = chr8:1362767-1362856
  misc_feature 1..89: note = Hypo
  source 1..89: mol_type = genomic DNA

SEQ ID NO: 128966 - DNA, 160 bp, Homo sapiens; identical to SEQ ID NO: 98739
  misc_feature 1..160: note = chr8:1380012-1380172
  misc_feature 1..160: note = Hypo
  source 1..160: mol_type = genomic DNA

SEQ ID NO: 128967 - DNA, 30 bp, Homo sapiens; identical to SEQ ID NO: 98753
  misc_feature 1..30: note = chr8:1400681-1400711
  misc_feature 1..30: note = Hypo
  source 1..30: mol_type = genomic DNA

SEQ ID NO: 128968 - DNA, 123 bp, Homo sapiens; identical to SEQ ID NO: 98808
  misc_feature 1..123: note = chr8:1420309-1420432
  misc_feature 1..123: note = Hypo
  source 1..123: mol_type = genomic DNA

SEQ ID NO: 128969 - DNA, 188 bp, Homo sapiens; identical to SEQ ID NO: 98826
  misc_feature 1..188: note = chr8:1423661-1423849
  misc_feature 1..188: note = Hypo
  source 1..188: mol_type = genomic DNA

SEQ ID NO: 128970 - DNA, 30 bp, Homo sapiens; identical to SEQ ID NO: 98968
  misc_feature 1..30: note = chr8:1438482-1438512
  misc_feature 1..30: note = Hypo
  source 1..30: mol_type = genomic DNA

SEQ ID NO: 128971 - DNA, 55 bp, Homo sapiens; identical to SEQ ID NO: 99025
  misc_feature 1..55: note = chr8:1443699-1443754
  misc_feature 1..55: note = Hypo
  source 1..55: mol_type = genomic DNA

SEQ ID NO: 128972 - DNA, 30 bp, Homo sapiens; identical to SEQ ID NO: 99098
  misc_feature 1..30: note = chr8:1463086-1463116
  misc_feature 1..30: note = Hypo
  source 1..30: mol_type = genomic DNA

SEQ ID NO: 128973 - DNA, 183 bp, Homo sapiens; identical to SEQ ID NO: 99099
  misc_feature 1..183: note = chr8:1471481-1471664
  misc_feature 1..183: note = Hypo
  source 1..183: mol_type = genomic DNA

SEQ ID NO: 128974 - DNA, 84 bp, Homo sapiens; identical to SEQ ID NO: 99101
  misc_feature 1..84: note = chr8:1501600-1501684
  misc_feature 1..84: note = Hypo
  source 1..84: mol_type = genomic DNA

SEQ ID NO: 128975 - DNA, 30 bp, Homo sapiens; identical to SEQ ID NO: 99102
  misc_feature 1..30: note = chr8:1507113-1507143
  misc_feature 1..30: note = Hypo
  source 1..30: mol_type = genomic DNA

SEQ ID NO: 128976 - DNA, 39 bp, Homo sapiens; identical to SEQ ID NO: 99109
  misc_feature 1..39: note = chr8:1569815-1569854
  misc_feature 1..39: note = Hypo
  source 1..39: mol_type = genomic DNA

SEQ ID NO: 128977 - DNA, 30 bp, Homo sapiens; identical to SEQ ID NO: 99110
  misc_feature 1..30: note = chr8:1574119-1574149
  misc_feature 1..30: note = Hypo
  source 1..30: mol_type = genomic DNA

SEQ ID NO: 128978 - DNA, 162 bp, Homo sapiens; identical to SEQ ID NO: 99111
  misc_feature 1..162: note = chr8:1574846-1575008
  misc_feature 1..162: note = Hypo
  source 1..162: mol_type = genomic DNA

SEQ ID NO: 128979 - DNA, 39 bp, Homo sapiens; identical to SEQ ID NO: 99112
  misc_feature 1..39: note = chr8:1579143-1579182
  misc_feature 1..39: note = Hypo
  source 1..39: mol_type = genomic DNA

SEQ ID NO: 128980 - DNA, 87 bp, Homo sapiens; identical to SEQ ID NO: 99113
  misc_feature 1..87: note = chr8:1581006-1581093
  misc_feature 1..87: note = Hypo
  source 1..87: mol_type = genomic DNA

SEQ ID NO: 128981 - DNA, 301 bp, Homo sapiens; identical to SEQ ID NO: 99114
  misc_feature 1..301: note = chr8:1588688-1588989
  misc_feature 1..301: note = Hypo
  source 1..301: mol_type = genomic DNA

SEQ ID NO: 128982 - DNA, 87 bp, Homo sapiens; identical to SEQ ID NO: 99115
  misc_feature 1..87: note = chr8:1592418-1592505
  misc_feature 1..87: note = Hypo
  source 1..87: mol_type = genomic DNA

SEQ ID NO: 128983 - DNA, 90 bp, Homo sapiens; identical to SEQ ID NO: 99116
  misc_feature 1..90: note = chr8:1613724-1613814
  misc_feature 1..90: note = Hypo
  source 1..90: mol_type = genomic DNA

SEQ ID NO: 128984 - DNA, 51 bp, Homo sapiens; identical to SEQ ID NO: 99117
  misc_feature 1..51: note = chr8:1616193-1616244
  misc_feature 1..51: note = Hypo
  source 1..51: mol_type = genomic DNA

SEQ ID NO: 128985 - DNA, 38 bp, Homo sapiens; identical to SEQ ID NO: 41686
  misc_feature 1..38: note = chr8:1645305-1645343
  misc_feature 1..38: note = Hypo
  source 1..38: mol_type = genomic DNA

SEQ ID NO: 128986 - DNA, 30 bp, Homo sapiens; identical to SEQ ID NO: 99130
  misc_feature 1..30: note = chr8:1771721-1771751
  misc_feature 1..30: note = Hyper
  source 1..30: mol_type = genomic DNA

SEQ ID NO: 128987 - DNA, 495 bp, Homo sapiens; identical to SEQ ID NO: 99131
  misc_feature 1..495: note = chr8:1772198-1772693
  misc_feature 1..495: note = Hyper
  source 1..495: mol_type = genomic DNA

SEQ ID NO: 128988 - DNA, 139 bp, Homo sapiens; identical to SEQ ID NO: 99132
  misc_feature 1..139: note = chr8:1778994-1779133
  misc_feature 1..139: note = Hypo
  source 1..139: mol_type = genomic DNA

SEQ ID NO: 128989 - DNA, 38 bp, Homo sapiens; identical to SEQ ID NO: 99133
  misc_feature 1..38: note = chr8:1784057-1784095
  misc_feature 1..38: note = Hypo
  source 1..38: mol_type = genomic DNA

SEQ ID NO: 128990 - DNA, 30 bp, Homo sapiens; identical to SEQ ID NO: 99136
  misc_feature 1..30: note = chr8:1811759-1811789
  misc_feature 1..30: note = Hypo
  source 1..30: mol_type = genomic DNA

SEQ ID NO: 128991 - DNA, 32 bp, Homo sapiens; identical to SEQ ID NO: 99138
  misc_feature 1..32: note = chr8:1857610-1857642
  misc_feature 1..32: note = Hypo
  source 1..32: mol_type = genomic DNA

SEQ ID NO: 128992 - DNA, 30 bp, Homo sapiens; identical to SEQ ID NO: 99144
  misc_feature 1..30: note = chr8:1921312-1921342
  misc_feature 1..30: note = Hyper
  source 1..30: mol_type = genomic DNA

SEQ ID NO: 128993 - DNA, 35 bp, Homo sapiens; identical to SEQ ID NO: 99145
  misc_feature 1..35: note = chr8:1921544-1921579
  misc_feature 1..35: note = Hyper
  source 1..35: mol_type = genomic DNA

SEQ ID NO: 128994 - DNA, 74 bp, Homo sapiens; identical to SEQ ID NO: 99146
  misc_feature 1..74: note = chr8:1922587-1922661
  misc_feature 1..74: note = Hyper
  source 1..74: mol_type = genomic DNA

SEQ ID NO: 128995 - DNA, 44 bp, Homo sapiens; identical to SEQ ID NO: 99236
  misc_feature 1..44: note = chr8:2536006-2536050
  misc_feature 1..44: note = Hypo
  source 1..44: mol_type = genomic DNA

SEQ ID NO: 128996 - DNA, 30 bp, Homo sapiens; identical to SEQ ID NO: 99237
  misc_feature 1..30: note = chr8:2537563-2537593
  misc_feature 1..30: note = Hypo
  source 1..30: mol_type = genomic DNA

SEQ ID NO: 128997 - DNA, 34 bp, Homo sapiens; identical to SEQ ID NO: 99238
  misc_feature 1..34: note = chr8:2538299-2538333
  misc_feature 1..34: note = Hypo
  source 1..34: mol_type = genomic DNA

SEQ ID NO: 128998 - DNA, 56 bp, Homo sapiens; identical to SEQ ID NO: 41689
  misc_feature 1..56: note = chr8:2652772-2652828
  misc_feature 1..56: note = Hypo
  source 1..56: mol_type = genomic DNA

SEQ ID NO: 128999 - DNA, 87 bp, Homo sapiens; identical to SEQ ID NO: 99299
  misc_feature 1..87: note = chr8:3036403-3036490
  misc_feature 1..87: note = Hypo
  source 1..87: mol_type = genomic DNA

SEQ ID NO: 129000 - DNA, 148 bp, Homo sapiens; identical to SEQ ID NO: 99300
  misc_feature 1..148: note = chr8:3040630-3040778
  misc_feature 1..148: note = Hypo
  source 1..148: mol_type = genomic DNA

SEQ ID NO: 129001 - DNA, 30 bp, Homo sapiens; identical to SEQ ID NO: 99317
  misc_feature 1..30: note = chr8:3245048-3245078
  misc_feature 1..30: note = Hypo
  source 1..30: mol_type = genomic DNA

SEQ ID NO: 129002 - DNA, 44 bp, Homo sapiens; identical to SEQ ID NO: 99336
  misc_feature 1..44: note = chr8:3769055-3769099
  misc_feature 1..44: note = Hypo
  source 1..44: mol_type = genomic DNA

SEQ ID NO: 129003 - DNA, 37 bp, Homo sapiens; identical to SEQ ID NO: 99438
  misc_feature 1..37: note = chr8:4671648-4671685
  misc_feature 1..37: note = Hypo
  source 1..37: mol_type = genomic DNA

SEQ ID NO: 129004 - DNA, 783 bp, Homo sapiens
  misc_feature 1..783: note = chr8:4849052-4849835
  misc_feature 1..783: note = Hyper
  source 1..783: mol_type = genomic DNA
gcgggagccgccacccgggcgcgcgcggcgcagctgcccacggcagtggccgggcgccctcctgccggagcgctcctccccgggaaagccctgctgcttgcaagcgcctccggtgggccctggagcgcgctgccgagccccggggcccagcgccgacgcccccggggggaggcccgaccttggtcacccgggctttgctaggcaaggggaacgcgacgccgccccaatggccagagcgcacaaacggcgactccggcgctggcgtcaccagcccccttcctgcctgcagccccttcccaggccggtacaggagctcgcacttgaccccgcaggcgtggaggagacacggtccctggtccctgtggggttaatgaaggagctccacggacccactgcctcgtgggccagacaatagcgcagtgagagctacgtccgagcgtcctggaccccctccgcgcgcacacacttgcgcacagcacctctccagctccatgcacgccaggggcctgggaccctgggctccacttctcggcttctacagccaggttctgggacctgcagcgcgcaagaggagctctcttccacggggctgccccgcagggcccgaggcgcccaggactttgcaacccctgccctgttcgccccagaatcatccagagcagcccccgcccactacctggccctccacaccctccctcccgcctccgcctcagcctcatcctagcgctgcagcccacccgcgtgggggcggaatccgcccggcacacacgtgtgcggattatt

SEQ ID NO: 129005 - DNA, 467 bp, Homo sapiens
  misc_feature 1..467: note = chr8:4850232-4850699
  misc_feature 1..467: note = Hyper
  source 1..467: mol_type = genomic DNA
gccctgctcagcaggcgctgcctccgcagccggcaatgtcagaggcaccggccaaggcatccggactgagccgggcgggtgggcagagggtcggcgtctgcaagaagctccccagtcccgagcgaccacgagcttgggtgactaagacccactgtttgcgatccccgagatctcggggcgcattcccgcagacacccccttgtgagggtggatgccggtgaggaggagctggtgctgagcggtcagctttcacggagccctggacgccccgtggaggcaagtgcagggaggggaagcccaggcggcacgtctctcccccgctctccaggcagatctggagtttcctaatgaaccagatacagtcctccttcgccctgccaatcactcttccatctggaccactggaggaaaaggaaatgggtggaaaagaagatggaagaatctagagaggacggggaaatattatg

SEQ ID NO: 129006 - DNA, 33 bp, Homo sapiens; identical to SEQ ID NO: 31747
  misc_feature 1..33: note = chr8:4851342-4851375
  misc_feature 1..33: note = Hyper
  source 1..33: mol_type = genomic DNA

SEQ ID NO: 129007 - DNA, 30 bp, Homo sapiens; identical to SEQ ID NO: 31748
  misc_feature 1..30: note = chr8:4851581-4851611
  misc_feature 1..30: note = Hyper
  source 1..30: mol_type = genomic DNA

SEQ ID NO: 129008 - DNA, 774 bp, Homo sapiens; identical to SEQ ID NO: 99464
  misc_feature 1..774: note = chr8:4851814-4852588
  misc_feature 1..774: note = Hyper
  source 1..774: mol_type = genomic DNA

SEQ ID NO: 129009 - DNA, 30 bp, Homo sapiens; identical to SEQ ID NO: 99515
  misc_feature 1..30: note = chr8:5347789-5347819
  misc_feature 1..30: note = Hypo
  source 1..30: mol_type = genomic DNA

SEQ ID NO: 129010 - DNA, 28 bp, Homo sapiens
  misc_feature 1..28: note = chr8:5949415-5949443
  misc_feature 1..28: note = Hypo
  source 1..28: mol_type = genomic DNA
gatcggcaaactccgtcttttctatccg

SEQ ID NO: 129011 - DNA, 25 bp, Homo sapiens
  misc_feature 1..25: note = chr8:6063181-6063206
  misc_feature 1..25: note = Hypo
  source 1..25: mol_type = genomic DNA
aaaaataagacgatgaacaaggatc

SEQ ID NO: 129012 - DNA, 30 bp, Homo sapiens; identical to SEQ ID NO: 99633
  misc_feature 1..30: note = chr8:6072853-6072883
  misc_feature 1..30: note = Hypo
  source 1..30: mol_type = genomic DNA

SEQ ID NO: 129013 - DNA, 121 bp, Homo sapiens; identical to SEQ ID NO: 99634
  misc_feature 1..121: note = chr8:6118678-6118799
  misc_feature 1..121: note = Hypo
  source 1..121: mol_type = genomic DNA

SEQ ID NO: 129014 - DNA, 210 bp, Homo sapiens; identical to SEQ ID NO: 99659
  misc_feature 1..210: note = chr8:6434302-6434512
  misc_feature 1..210: note = Hypo
  source 1..210: mol_type = genomic DNA

SEQ ID NO: 129015 - DNA, 30 bp, Homo sapiens; identical to SEQ ID NO: 99665
  misc_feature 1..30: note = chr8:6526266-6526296
  misc_feature 1..30: note = Hypo
  source 1..30: mol_type = genomic DNA

SEQ ID NO: 129016 - DNA, 30 bp, Homo sapiens; identical to SEQ ID NO: 41694
  misc_feature 1..30: note = chr8:6542607-6542637
  misc_feature 1..30: note = Hypo
  source 1..30: mol_type = genomic DNA

SEQ ID NO: 129017 - DNA, 30 bp, Homo sapiens; identical to SEQ ID NO: 99705
  misc_feature 1..30: note = chr8:6637553-6637583
  misc_feature 1..30: note = Hypo
  source 1..30: mol_type = genomic DNA

SEQ ID NO: 129018 - DNA, 79 bp, Homo sapiens; identical to SEQ ID NO: 99710
  misc_feature 1..79: note = chr8:6663499-6663578
  misc_feature 1..79: note = Hypo
  source 1..79: mol_type = genomic DNA

SEQ ID NO: 129019 - DNA, 411 bp, Homo sapiens; identical to SEQ ID NO: 99711
  misc_feature 1..411: note = chr8:6692051-6692462
  misc_feature 1..411: note = Hyper
  source 1..411: mol_type = genomic DNA

SEQ ID NO: 129020 - DNA, 484 bp, Homo sapiens; identical to SEQ ID NO: 99712
  misc_feature 1..484: note = chr8:6692686-6693170
  misc_feature 1..484: note = Hyper
  source 1..484: mol_type = genomic DNA

SEQ ID NO: 129021 - DNA, 21 bp, Homo sapiens
  misc_feature 1..21: note = chr8:6774704-6774725
  misc_feature 1..21: note = Hypo
  source 1..21: mol_type = genomic DNA
ttcattttggctgggcgcggt

SEQ ID NO: 129022 - DNA, 87 bp, Homo sapiens; identical to SEQ ID NO: 99754
  misc_feature 1..87: note = chr8:6932550-6932637
  misc_feature 1..87: note = Hypo
  source 1..87: mol_type = genomic DNA

SEQ ID NO: 129023 - DNA, 151 bp, Homo sapiens; identical to SEQ ID NO: 99755
  misc_feature 1..151: note = chr8:6940557-6940708
  misc_feature 1..151: note = Hypo
  source 1..151: mol_type = genomic DNA

SEQ ID NO: 129024 - DNA, 62 bp, Homo sapiens
  misc_feature 1..62: note = chr8:8559755-8559817
  misc_feature 1..62: note = Hyper
  source 1..62: mol_type = genomic DNA
cagggctcaggagcccgacccggagcccggggcgtccgcgctgacttcgggtccccggagcc

SEQ ID NO: 129025 - DNA, 236 bp, Homo sapiens; identical to SEQ ID NO: 99883
  misc_feature 1..236: note = chr8:8560796-8561032
  misc_feature 1..236: note = Hypo
  source 1..236: mol_type = genomic DNA

SEQ ID NO: 129026 - DNA, 360 bp, Homo sapiens; identical to SEQ ID NO: 99890
  misc_feature 1..360: note = chr8:8639440-8639800
  misc_feature 1..360: note = Hypo
  source 1..360: mol_type = genomic DNA

SEQ ID NO: 129027 - DNA, 120 bp, Homo sapiens; identical to SEQ ID NO: 99891
  misc_feature 1..120: note = chr8:8639860-8639980
  misc_feature 1..120: note = Hypo
  source 1..120: mol_type = genomic DNA

SEQ ID NO: 129028 - DNA, 75 bp, Homo sapiens; identical to SEQ ID NO: 99904
  misc_feature 1..75: note = chr8:8666327-8666402
  misc_feature 1..75: note = Hypo
  source 1..75: mol_type = genomic DNA

SEQ ID NO: 129029 - DNA, 30 bp, Homo sapiens; identical to SEQ ID NO: 99911
  misc_feature 1..30: note = chr8:8709733-8709763
  misc_feature 1..30: note = Hypo
  source 1..30: mol_type = genomic DNA

SEQ ID NO: 129030 - DNA, 738 bp, Homo sapiens; identical to SEQ ID NO: 99912
  misc_feature 1..738: note = chr8:8748350-8749088
  misc_feature 1..738: note = Hypo
  source 1..738: mol_type = genomic DNA

SEQ ID NO: 129031 - DNA, 30 bp, Homo sapiens; identical to SEQ ID NO: 41699
  misc_feature 1..30: note = chr8:8898369-8898399
  misc_feature 1..30: note = Hypo
  source 1..30: mol_type = genomic DNA

SEQ ID NO: 129032 - DNA, 30 bp, Homo sapiens; identical to SEQ ID NO: 41700
  misc_feature 1..30: note = chr8:8898687-8898717
  misc_feature 1..30: note = Hypo
  source 1..30: mol_type = genomic DNA

SEQ ID NO: 129033 - DNA, 30 bp, Homo sapiens; identical to SEQ ID NO: 99986
  misc_feature 1..30: note = chr8:9638573-9638603
  misc_feature 1..30: note = Hypo
  source 1..30: mol_type = genomic DNA

SEQ ID NO: 129034 - DNA, 165 bp, Homo sapiens; identical to SEQ ID NO: 99989
  misc_feature 1..165: note = chr8:9686554-9686719
  misc_feature 1..165: note = Hypo
  source 1..165: mol_type = genomic DNA

SEQ ID NO: 129035 - DNA, 46 bp, Homo sapiens; identical to SEQ ID NO: 100010
  misc_feature 1..46: note = chr8:9722850-9722896
  misc_feature 1..46: note = Hypo
  source 1..46: mol_type = genomic DNA

SEQ ID NO: 129036 - DNA, 30 bp, Homo sapiens; identical to SEQ ID NO: 100018
  misc_feature 1..30: note = chr8:9751525-9751555
  misc_feature 1..30: note = Hypo
  source 1..30: mol_type = genomic DNA

SEQ ID NO: 129037 - DNA, 547 bp, Homo sapiens
  misc_feature 1..547: note = chr8:9755968-9756515
  misc_feature 1..547: note = Hyper
  source 1..547: mol_type = genomic DNA
tgcccgctccctggccgggtcactgggggtatccgggagaggaggctggatgtatgggcggggcgtcctaatggggaatccaggaggatgcactgagacggaccccccactccagcaaataaaacccaacccccaagcgctttcgcggcggggtcctcttcccaggctgcacctgccagcccctctttcttgcaagttctgaggctttccgggatgcacggtggggtcctcgaggccgcaggtactgaagtggatcagagagaggcccggagccgcactgcgggcgccgggcgcacaggctgaccggctgcacggccgggagggcgcggcttctaggcccaggcctgcggctggggagcgctgtgggtggccaggggaggacgtgacctcccgcccaggccttcggtctggctcggccacccttggaagcaaaggatgtaccctcgtctcaattcgtcccgcttcctgcccccgactccggaaaaatctctaacgttgaccgtcgagtgtccatctggcgctagagtgaaatcgatgtgcatggaaa

SEQ ID NO: 129038 - DNA, 420 bp, Homo sapiens; identical to SEQ ID NO: 100022
  misc_feature 1..420: note = chr8:9760735-9761155
  misc_feature 1..420: note = Hyper
  source 1..420: mol_type = genomic DNA

SEQ ID NO: 129039 - DNA, 324 bp, Homo sapiens; identical to SEQ ID NO: 100023
  misc_feature 1..324: note = chr8:9761415-9761739
  misc_feature 1..324: note = Hyper
  source 1..324: mol_type = genomic DNA

SEQ ID NO: 129040 - DNA, 504 bp, Homo sapiens; identical to SEQ ID NO: 100024
  misc_feature 1..504: note = chr8:9761799-9762303
  misc_feature 1..504: note = Hyper
  source 1..504: mol_type = genomic DNA

SEQ ID NO: 129041 - DNA, 2500 bp, Homo sapiens
  misc_feature 1..2500: note = chr8:9762586-9765086
  misc_feature 1..2500: note = Hyper
  source 1..2500: mol_type = genomic DNA
agaccccaacaaccccgacccctctcctacgtagacactgtgaaagcaagccacagggacaaataaaagacaatccgaataccctcagcgttccgcacgccgggcggacgcccttccgcagcggccacgcgtgttctgggttcagcgctcctgcgcgtcccttctcgccgaacccaaggtgctttgtcccggcggccacacaaggtcttcggctttttgttctccttttttaagagactggccgcagtccccagcgattcagccggcccaaccaaaggcagtggatctactgaaatgaaaaggatcgagataatacacaggcagatgaataaggggggggatgctggaggtgcaggaagcatcctgggagcggccgccacggccaagcccgaactgcttgctgccttcgctggggaaggcgcaggaggcgagccggcgctggtggtcgctccacctggcaggaggaaatgataaccatgataaggaacgtgatgatgatgatgatgatgatgatgatgatgatgagcatgatttaaaaaaaatcagtctccctcttggtgaaccagagcatgcgtgccggagggactgcactgctggcggcggcggccgggggaaggagagcggcgcaggaggcaaaggttgaggaggcagcaccctcggatgaataataacaccgcgccgcgcaagttgcggagccgcctggaaatccagcccttcgcgtgaactcgcgtcgagcgcggattgcaggggatgaggaagaagggggaggggaggggagggtggaggagggagggggaggggtagaggggaaggcagagagggacagagagaattgggagccttttaatttttccttaccaagccctaatctcgtgcgccgtcctctttggctgaggtcgagctcctttttaaaaattattactcctttaaaggattattcaggtaaaggaagccgcatctgctgacggttccgaaaacaagaggattaggagcccgtccacagatccaggcccgcagacccccaccccctctgcaccagcacacgtcattctcactgcccccgggtacctccctctccttcgtgctcggggagagctgtgccaaggaaaatgcggatttggggaaagtgagaagtgggagagctcggaagagcgggaaagccaaggccggaggtggcgattcgcacccccacactcacacgcgcttccgtttatccgtttctatcccgggaaaagggggcgcctgcccgagcccacgcgcgccgccgcatctgcagcggtcggcgccccacgctccctgaacgccccccaggcggcaccagtgccgggcagagtcccctcggcggccgcgggcgtcaaatcgacacctgactccacagctcccttccctctcctcttcttccacctccccgggggtccaggcaccgccgtgcgtccactcccggtctccacggcttaggcagacggagtgggggactccggggacccgcgcgtcctctcctcctcggccctggcgggaggagccgggctggggtttccgcgggccgcggcgcgttttagggctgccggggactgcggcggatgcggttgacatcactgcggcggctgccgggccgctgcggcgacctgagcgccggtgcagcctcccccaccccgcctgggcgggcgtctgggcaggacagctgcggggggttgggagaggagtcggggagagggggacgatcgccccatcccccgcccccccgcagtcaaggtgaacatgaaggagagccggcgcgcgtgcccgcgcctgggaggcgcgcggccccgcccctcccggagccctccagcgcgcccgggccagatggacgcccgagattagaggcgcagaagtgcgctccacgacgggcccacccgtcccgcggacatcagacctacttcggggaggcgccttttgttgtggtggccgtggcggtgtttgtgtctttccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagcagccctgctgaaaccacacagcccgcgagggtcgcagcagaggcgcccacccagcaggagtggctgcacgaagggtgacccgggcgaggcccttctcgcttcgaggccatttcggctcttgtcaattattgggtgtttgtcccaatataagtagaatggcgatctcaaaccctt

SEQ ID NO: 129042 - DNA, 30 bp, Homo sapiens; identical to SEQ ID NO: 100051
  misc_feature 1..30: note = chr8:9993158-9993188
  misc_feature 1..30: note = Hypo
  source 1..30: mol_type = genomic DNA

SEQ ID NO: 129043 - DNA, 159 bp, Homo sapiens; identical to SEQ ID NO: 98318
  misc_feature 1..159: note = chr8:10005422-10005581
  misc_feature 1..159: note = Hypo
  source 1..159: mol_type = genomic DNA

SEQ ID NO: 129044 - DNA, 35 bp, Homo sapiens; identical to SEQ ID NO: 98320
  misc_feature 1..35: note = chr8:10019317-10019352
  misc_feature 1..35: note = Hypo
  source 1..35: mol_type = genomic DNA

SEQ ID NO: 129045 - DNA, 156 bp, Homo sapiens; identical to SEQ ID NO: 98321
  misc_feature 1..156: note = chr8:10022508-10022664
  misc_feature 1..156: note = Hypo
  source 1..156: mol_type = genomic DNA

SEQ ID NO: 129046 - DNA, 78 bp, Homo sapiens; identical to SEQ ID NO: 98347
  misc_feature 1..78: note = chr8:10192879-10192957
  misc_feature 1..78: note = Hypo
  source 1..78: mol_type = genomic DNA

SEQ ID NO: 129047 - DNA, 75 bp, Homo sapiens; identical to SEQ ID NO: 98350
  misc_feature 1..75: note = chr8:10210850-10210925
  misc_feature 1..75: note = Hypo
  source 1..75: mol_type = genomic DNA

SEQ ID NO: 129048 - DNA, 100 bp, Homo sapiens; identical to SEQ ID NO: 98352
  misc_feature 1..100: note = chr8:10218064-10218164
  misc_feature 1..100: note = Hypo
  source 1..100: mol_type = genomic DNA

SEQ ID NO: 129049 - DNA, 39 bp, Homo sapiens; identical to SEQ ID NO: 98353
  misc_feature 1..39: note = chr8:10224220-10224259
  misc_feature 1..39: note = Hypo
  source 1..39: mol_type = genomic DNA

SEQ ID NO: 129050 - DNA, 30 bp, Homo sapiens; identical to SEQ ID NO: 98354
  misc_feature 1..30: note = chr8:10248245-10248275
  misc_feature 1..30: note = Hypo
  source 1..30: mol_type = genomic DNA

SEQ ID NO: 129051 - DNA, 148 bp, Homo sapiens; identical to SEQ ID NO: 98359
  misc_feature 1..148: note = chr8:10261838-10261986
  misc_feature 1..148: note = Hypo
  source 1..148: mol_type = genomic DNA

SEQ ID NO: 129052 - DNA, 84 bp, Homo sapiens; identical to SEQ ID NO: 98378
  misc_feature 1..84: note = chr8:10509949-10510033
  misc_feature 1..84: note = Hypo
  source 1..84: mol_type = genomic DNA

SEQ ID NO: 129053 - DNA, 142 bp, Homo sapiens; identical to SEQ ID NO: 41704
  misc_feature 1..142: note = chr8:10528983-10529125
  misc_feature 1..142: note = Hypo
  source 1..142: mol_type = genomic DNA

SEQ ID NO: 129054 - DNA, 77 bp, Homo sapiens; identical to SEQ ID NO: 98390
  misc_feature 1..77: note = chr8:10548185-10548262
  misc_feature 1..77: note = Hypo
  source 1..77: mol_type = genomic DNA

SEQ ID NO: 129055 - DNA, 165 bp, Homo sapiens; identical to SEQ ID NO: 98395
  misc_feature 1..165: note = chr8:10562094-10562259
  misc_feature 1..165: note = Hypo
  source 1..165: mol_type = genomic DNA

SEQ ID NO: 129056 - DNA, 1245 bp, Homo sapiens
  misc_feature 1..1245: note = chr8:10587422-10588667
  misc_feature 1..1245: note = Hyper
  source 1..1245: mol_type = genomic DNA
ccccgccccctggggcgccgatctccgctcctgtcccagcagaggagcctccctgcccgccgcgcggtttcactttggaccgcgccaagtgcccccgctctgaatcctgggcaccgcgagcacccacgctcgcgcagatggccagccacgcgggcacgaagagggccctcgtcccgcgtgccgggtcttccccaggctccgcgctcgcacccgccctgcagtgccgccagccgcccgccgcccgcccccggcccccagcccgctcggccgcgcgctcactcacccagcatcttgctgagctcggcgttgtgcaggtccgggttctgcactgccagccgtttcctctcgtccttggcccaaaccatgaaggcgttcatgggccgccggatacggctctcggagcccttgtcccccgggggccgggggacggccggcggcgattgtccatccgacagctcggcgtccagggccgggcactcgagaccctcgggccaagggtaggctcccagcagcgaagccatggccgcacgcgggtcgcctcgcttcgcctggcggggcaggcgcggacctggccctcgcacgggtcggggcgtccaacttggcccgcagccgcgacccggcccctgatttatcagcttcgggcggccgcgtcctccaatgactctccaaggcggcgcggcccctccctcggtgtcggcgcgggtcccctccctgcgtcccgggccgccgccgggtccccgctccgacctgccgggaggaggacggagggagggagtgagggagggcctcctccccgcgcctgcccccggcccgcccctccgccgccagggcccgcccggggatctgcgcccggctgccccgggccgcctcccgccccctgccctggacccgcaggtgccgcagagacgcaaggcaggcgctggaggcccgctccagcccctgcctgcccgggccagactccaccgccctccctgcgcgtgtggcctcagaaaatcaacccaaccaggtttcgccgagcccgcctgggtgtgagagacattgaccatgaacccctcagagcagccgttcttaatactccgactgccattcctttcgaaaatgaccgggcttcggccaccgcagccccagtcaacttgggccgccacagaggccggccggagccggggctgggggccgcatcccgcctcgggttctgtgcagtgctcacccaagacccctcgacgcccccgccgcccctggctctca

SEQ ID NO: 129057 - DNA, 78 bp, Homo sapiens; identical to SEQ ID NO: 98402
  misc_feature 1..78: note = chr8:10590855-10590933
  misc_feature 1..78: note = Hyper
  source 1..78: mol_type = genomic DNA

SEQ ID NO: 129058 - DNA, 56 bp, Homo sapiens; identical to SEQ ID NO: 98417
  misc_feature 1..56: note = chr8:10694858-10694914
  misc_feature 1..56: note = Hypo
  source 1..56: mol_type = genomic DNA

SEQ ID NO: 129059 - DNA, 30 bp, Homo sapiens
  misc_feature 1..30: note = chr8:10708309-10708339
  misc_feature 1..30: note = Hyper
  source 1..30: mol_type = genomic DNA
ggcggtgggcgggggcggcggggaacaacg

SEQ ID NO: 129060 - DNA, 208 bp, Homo sapiens; identical to SEQ ID NO: 98439
  misc_feature 1..208: note = chr8:10873441-10873649
  misc_feature 1..208: note = Hyper
  source 1..208: mol_type = genomic DNA

SEQ ID NO: 129061 - DNA, 153 bp, Homo sapiens; identical to SEQ ID NO: 98440
  misc_feature 1..153: note = chr8:10873889-10874042
  misc_feature 1..153: note = Hyper
  source 1..153: mol_type = genomic DNA

SEQ ID NO: 129062 - DNA, 30 bp, Homo sapiens; identical to SEQ ID NO: 98441
  misc_feature 1..30: note = chr8:10874300-10874330
  misc_feature 1..30: note = Hyper
  source 1..30: mol_type = genomic DNA

SEQ ID NO: 129063 - DNA, 255 bp, Homo sapiens; identical to SEQ ID NO: 98451
  misc_feature 1..255: note = chr8:10916999-10917254
  misc_feature 1..255: note = Hyper
  source 1..255: mol_type = genomic DNA

SEQ ID NO: 129064 - DNA, 30 bp, Homo sapiens; identical to SEQ ID NO: 98453
  misc_feature 1..30: note = chr8:10928999-10929029
  misc_feature 1..30: note = Hypo
  source 1..30: mol_type = genomic DNA

SEQ ID NO: 129065 - DNA, 30 bp, Homo sapiens; identical to SEQ ID NO: 98455
  misc_feature 1..30: note = chr8:10959729-10959759
  misc_feature 1..30: note = Hypo
  source 1..30: mol_type = genomic DNA

SEQ ID NO: 129066 - DNA, 57 bp, Homo sapiens; identical to SEQ ID NO: 98456
  misc_feature 1..57: note = chr8:10966208-10966265
  misc_feature 1..57: note = Hypo
  source 1..57: mol_type = genomic DNA

SEQ ID NO: 129067 - DNA, 34 bp, Homo sapiens; identical to SEQ ID NO: 98463
  misc_feature 1..34: note = chr8:11049928-11049962
  misc_feature 1..34: note = Hypo
  source 1..34: mol_type = genomic DNA

SEQ ID NO: 129068 - DNA, 33 bp, Homo sapiens; identical to SEQ ID NO: 98464
  misc_feature 1..33: note = chr8:11053392-11053425
  misc_feature 1..33: note = Hypo
  source 1..33: mol_type = genomic DNA

SEQ ID NO: 129069 - DNA, 647 bp, Homo sapiens
  misc_feature 1..647: note = chr8:11058152-11058799
  misc_feature 1..647: note = Hyper
  source 1..647: mol_type = genomic DNA
gcgctgcgcccccggcgtgggggagaccctcacgcctgggccaccgcgggccgcgccgtggacgtagccggcccccatcatgggggggccccggctggtgagcccctccacggcgcccagcccgccgcccgtgtagtcctgcacgaaccagcggaagctcaggctctgcaccagcagcgacggcaccagcacgaagaagagggtcagcccgaagtagacgtagtcccccttgcggtagtagtcgagggccagccacaggtcggtgcccacgtccccgaagaacaccagcagcgccagcacgatccacaggcagtcgagccacggccgctccacctgcggcggcggcggctccggccgcgcggccgagggcgtcgggggttggcggccggcgccgggggccgcgggaggctgcagcggctggtcccccccgtcggcggcggcgctgcggcgcggcttcctgcccaggagggagcgcaggcaggcggagcggcagccccagtagcacgaggaggtgttgcagcagtggcagatgtgcatcgagctgctctcgccgggctcgctgccgtcgccgccgccgccgcagccgcctcccccgggctccccgtcctcctcgccgccgctgcccaccgcctcgtccaggttgtgca

SEQ ID NO: 129070 - DNA, 1223 bp, Homo sapiens
  misc_feature 1..1223: note = chr8:11204479-11205702
  misc_feature 1..1223: note = Hyper
  source 1..1223: mol_type = genomic DNA
gattgcaatatgcagcggagtttgagaaccagcgccttggacccagcttcttaagctactgcgcgcaccggcgtcccgctgggggcgcgcgagccccacccccagagatgctgactcagcaagtcgggaggggttgggggtgggacctgccaatctgcatttccaaccggcgcccaggtgacgctgactctgctggtctaccgtcttgggggtcacctaatttttcagcgatgcctcccagctggggaggccaagaagtgcctcgctcaaggtcttccaacacccgacctccagaccctcaatcctgggccagctacaccgcaaacctttccagctgtctctcctgcgccctgcgtttcttccccacgtcacttgccagggagccgctaaacagcaagaccgcgcgctctgcggctccagagtgcggatttcggtcgcgtgcggctctgaccgcgtcgccccatccctggcggggccacgcacggacgccatggctggcgccgcggagccgggcgatgcgcgcggactctcccggggccctgactgtccctgagtcctccctgcggggggcgtgcgcggcccgccccccgcggcgccacgcggcccctcctcggccggggattggtgcgccgggcggggcggggcggggcgggataaaggcgcggggtctggctgcgcggggtctgcgggcagctccaactctgggttcgtagtttgcgctgggtgcgcaggaaggtcagtgtgggggtcgcccgacatttcccccccgcggaggtgggagccgagccacatcttggagtggggactggccgcggagcgggttgcccagggccggccgaggtcggggcgagccctgcgcggcgctggagactctgcattcccgggcgcgcgcagggtccccggccgtggtcgcagagtcaggaggggcggctccggagcccggcgcggggagggcccaggcgcagtcggggttggcagggcgcgacactcgctcccctccacttttgaaagggcttcccacgccgagaagaggggcgggcatggccggcccggcgaaaccggtttgtacagactttgggaagccatcgcctgcggagggtgggaccccacagcttgtccacctgcccaggctgagacctcgtgtcctagtcctggatgccccacgggtttctcgtcccgggcagcggcgcacgggaggagaagactcccggtctgcagtcaga

SEQ ID NO: 129071 - DNA, 61 bp, Homo sapiens; identical to SEQ ID NO: 9392
  misc_feature 1..61: note = chr8:11206007-11206068
  misc_feature 1..61: note = Hyper
  source 1..61: mol_type = genomic DNA

SEQ ID NO: 129072 - DNA, 218 bp, Homo sapiens; identical to SEQ ID NO: 98487
  misc_feature 1..218: note = chr8:11302089-11302307
  misc_feature 1..218: note = Hypo
  source 1..218: mol_type = genomic DNA

SEQ ID NO: 129073 - DNA, 478 bp, Homo sapiens
  misc_feature 1..478: note = chr8:11536805-11537283
  misc_feature 1..478: note = Hyper
  source 1..478: mol_type = genomic DNA
gaaggttctcagactcggggatgggggaggaaggggacgtttctagaagaaacttaaagggggctcgcgccgcacgactgtaggtggagggcgtgcgccgcgggacgccccagccgggtctgataaagccccgaagccgatctaaggtcaataaaccaggcggcgtcaggcttgggccgagggccgggaggagaggagagtggagccctctcaggctggcggcggaatgaaaaggaaccccgactgctggggtccgagccctgggccgcttgcggggcgcgcagccggggagaggagctgggcgcgcggcctgggccccccacctgcccgaccccagggcagccaagcacccgcggccttaaaagtatcccggcgagccctgagtgggccgggtgctgggcgaacagtcctagccctgcactgaggttggaaaagcgaacggaaagtgacatttttacaggggcgaggttgggatcgg

SEQ ID NO: 129074 - DNA, 381 bp, Homo sapiens
  misc_feature 1..381: note = chr8:11537839-11538220
  misc_feature 1..381: note = Hyper
  source 1..381: mol_type = genomic DNA
aacgggccctggagccggggaatctctgcaagtaactaaccaggcccctcggattcattgccactttcccgccctcggcccacgaggctgaggagctccctctcatcgcctctccgttcctggcaaggccgaagccggtttgctttggatgcatttcgatcaatctggcgccacatgggccaggtcacctcggacgggtgtcgcgccgacgtccttcgtggtcgcacgctggtgggccaggaagcccaggctatgcccagccgggtccgagcggcggtcggtggcgtgacctcttgccacgcctggcgctgctgggaacgtgtctcgggtcgccctttgcgtcagagaccccccccttggggagaccggaatcctccagcc

SEQ ID NO: 129075 - DNA, 30 bp, Homo sapiens; identical to SEQ ID NO: 31778
  misc_feature 1..30: note = chr8:11540426-11540456
  misc_feature 1..30: note = Hyper
  source 1..30: mol_type = genomic DNA

SEQ ID NO: 129076 - DNA, 343 bp, Homo sapiens; identical to SEQ ID NO: 98517
  misc_feature 1..343: note = chr8:11550025-11550368
  misc_feature 1..343: note = Hyper
  source 1..343: mol_type = genomic DNA

SEQ ID NO: 129077 - DNA, 82 bp, Homo sapiens; identical to SEQ ID NO: 98518
  misc_feature 1..82: note = chr8:11550619-11550701
  misc_feature 1..82: note = Hyper
  source 1..82: mol_type = genomic DNA

SEQ ID NO: 129078 - DNA, 552 bp, Homo sapiens
  misc_feature 1..552: note = chr8:11554969-11555521
  misc_feature 1..552: note = Hyper
  source 1..552: mol_type = genomic DNA
tggggaagcggtgttcggaggggagcagcgctctcggtgggcacctgctgcagttggggagggagaggtggtcgtggaggccactttcccctccaccgccagggaagcctggtctgtctgaaggggtcctcgcctgcgccgaggatggccggacggccgggcctccggccccagcacagcccccctttcagaggaccccgggtcttcgcgcctgcggaccagaggctgttttcgcacttgggcttcgcgcttccttgacactttcctgtctctgctcgccgcgccaggtcgcggcgcctgcctgggcgtcttctccaactccgggtcacctcggggcgagggcaagggtgccgggccggtggggcgttccggccaccacggggcggaggagggagcggcctttgcggaaacgggccgagctggctcagggaatgccagatctctgggggacccaccagtcccctgatgtgcgcgttgaggtcttgggcctggcggcgctccagccgcgggtgtccctaccataaccactgtcctccccgggagctgggcaag

SEQ ID NO: 129079 - DNA, 73 bp, Homo sapiens; identical to SEQ ID NO: 98521
  misc_feature 1..73: note = chr8:11558318-11558391
  misc_feature 1..73: note = Hyper
  source 1..73: mol_type = genomic DNA

SEQ ID NO: 129080 - DNA, 44 bp, Homo sapiens
  misc_feature 1..44: note = chr8:11559650-11559694
  misc_feature 1..44: note = Hyper
  source 1..44: mol_type = genomic DNA
actactaggagaagccggcgtaggagcgccgcctgtgtccttgg

SEQ ID NO: 129081 - DNA, 873 bp, Homo sapiens
  misc_feature 1..873: note = chr8:11560022-11560895
  misc_feature 1..873: note = Hyper
  source 1..873: mol_type = genomic DNA
gtctgcttccttctccgctgagtccgaaggatcgcagattggagcgtgctccggagaccgcttttccgcagcgccggcctccgagatccccagcaccccttcagccttaagttcccacgtttcgggtccgtggcgccaattctgctaagtagcaggctaggaattgggggaagtcggagaagaaaccctaagtgtgtcgcccccagcttccgggatgcaggcccgccggggtctagaggggcggctgccgtgcgtccagcctgtgcgcaggcctttcgccgctcggcgccccaggcagcctcagtttcctttcctctgtttgcgccccagtgaacctccgcacctctcattcagggaagagaattccccgcgcagccgcgctcgtttcttcctctgggattttcctgagaatccccaggagttggccacgatcccatggggggtttccttctacccagccccgcgtcctggcctcgtccttaacccccgggttgccttcactcaggctgggaatccacgattgatttcctactacggaagcgggtggcgttcccagcctgctttcggagcagcacgggtttcgtgcagggtgttatcccgaccccttcccccatccctctaatctggcttgagaagcccgtgctggagagaaaaacgcggccttaaaaaaaaaaaaaagtttaaccgaaagcgtgagagccacccgccggctgttatctggggctgaaggctgcggtaatcgatgggttatttttacgcggtaatagggccctgtgattgctctattaacctttagacctgtctgagggactctccggctcgcagccccgctgcgctggggcctccaggctctgacgccgactcccaactcag

SEQ ID NO: 129082 - DNA, 30 bp, Homo sapiens; identical to SEQ ID NO: 9400
  misc_feature 1..30: note = chr8:11561116-11561146
  misc_feature 1..30: note = Hyper
  source 1..30: mol_type = genomic DNA

SEQ ID NO: 129083 - DNA, 1665 bp, Homo sapiens
  misc_feature 1..1665: note = chr8:11561391-11563056
  misc_feature 1..1665: note = Hyper
  source 1..1665: mol_type = genomic DNA
cacaggaagggggggcggggagggagaaagggaactcattaataaagctgaccctgggcaccacagcgaacccaatcgacctccggctgggttgcgggtgattccccgctccctggcggtagcacttgggcattttccgcggagaccccagagcctggactttgcctgctgggggagctttccgcacagtcccgcagcctgcgcccagcggaggtgtagccggggccgcgcacccccgccccgcccttgcacgtgactcccacaggccagtcagcgccctagggccgagttgctgggccggggacccgagccgcgagctggggacttggaggcggccggcgcaggggccgcgagaggcttcgtcgccgctgcagctccgggggctcccaggggagcgtgcgcggaacctccaggcccagcaggtagggcttttttcttccctttctttgctccttcccgcggtcccccaaactcggagcttctccgcctttgcttgtctggaggtagagaggtagctagtgggaggaaaagagacgtgcgctactcacttcaccgaaattgcccaacccctgctctgcttttgactttgccttagcaacttctttaagtcaaagtaagacttgggggcaaaacagagaaatattggaagcgcctttggattctttccgtgtgaacttgaacgctttcaatccctgtccccgtgtgcacattctccaacccttgtttgcatatcgcaggccggggcctgggtggtgatggtggccgcgtgaagttaccgggactgacgggcccgggacaggctgcacggcagctcgcacatggagggaagtagacggaggcttgtcgcccaccagcgactccggggacgcagggtggcagtgccaggcagctccgctgggcctcaggggcccccgggagccgctctgaggtgcggagaggctgctgagtggcggaactattcatgccctttctggccggcctcctcgccctcggggctggggtccagggactgaatgctcctctggaagctcaccaccccacctgcccgcgctgcttctacctgaaactggccaagggcccgagcccggaccggagccgtgacttccctccgccggccacggggctgcccggatccgccgggttatgtcgcttggctttgggctcaggggtcaccgtgggcagaggggggtgccggggtcgcggactgccaccaggttgaggaaaggaggggccttttggctggggaaagagcgtggtgggggacccgcggccgatggaatccctggggcagcgcggcccgcaccgtggaggttggggaagcgcctcggggaagtgtttcctgtgttcccagaaaaggaagacaaccgagagcaggtttcaggcttttaaagaaagcctggggtgtggaggtgatgctccgcacacgtctgtgtctcctcccctgctgcggccggcttggttgtgccggctagcgtgcgaccgtcctcctcgctgcaggccgagagcggaggcgtaaacccaggccagcgaggagtgtcctataaagggacggggacttttcggcgcttgcaattctcccattctgaaaaatagatcggaagagggctattggttgattcttgaaaggggagcgcatttcctgttggcctgcgaatttggggtgaa

SEQ ID NO: 129084 - DNA, 30 bp, Homo sapiens; identical to SEQ ID NO: 98529
  misc_feature 1..30: note = chr8:11615747-11615777
  misc_feature 1..30: note = Hypo
  source 1..30: mol_type = genomic DNA

SEQ ID NO: 129085 - DNA, 30 bp, Homo sapiens; identical to SEQ ID NO: 98531
  misc_feature 1..30: note = chr8:11656439-11656469
  misc_feature 1..30: note = Hypo
  source 1..30: mol_type = genomic DNA

SEQ ID NO: 129086 - DNA, 134 bp, Homo sapiens; identical to SEQ ID NO: 98536
  misc_feature 1..134: note = chr8:11704540-11704674
  misc_feature 1..134: note = Hypo
  source 1..134: mol_type = genomic DNA

SEQ ID NO: 129087 - DNA, 238 bp, Homo sapiens; identical to SEQ ID NO: 41707
  misc_feature 1..238: note = chr8:11705917-11706155
  misc_feature 1..238: note = Hypo
  source 1..238: mol_type = genomic DNA

SEQ ID NO: 129088 - DNA, 64 bp, Homo sapiens; identical to SEQ ID NO: 98539
  misc_feature 1..64: note = chr8:11708426-11708490
  misc_feature 1..64: note = Hypo
  source 1..64: mol_type = genomic DNA

SEQ ID NO: 129089 - DNA, 36 bp, Homo sapiens; identical to SEQ ID NO: 98540
  misc_feature 1..36: note = chr8:11726469-11726505
  misc_feature 1..36: note = Hypo
  source 1..36: mol_type = genomic DNA

SEQ ID NO: 129090 - DNA, 131 bp, Homo sapiens; identical to SEQ ID NO: 98543
  misc_feature 1..131: note = chr8:11772171-11772302
  misc_feature 1..131: note = Hypo
  source 1..131: mol_type = genomic DNA

SEQ ID NO: 129091 - DNA, 42 bp, Homo sapiens; identical to SEQ ID NO: 98594
  misc_feature 1..42: note = chr8:12403483-12403525
  misc_feature 1..42: note = Hypo
  source 1..42: mol_type = genomic DNA

SEQ ID NO: 129092 - DNA, 149 bp, Homo sapiens; identical to SEQ ID NO: 41711
  misc_feature 1..149: note = chr8:12671777-12671926
  misc_feature 1..149: note = Hypo
  source 1..149: mol_type = genomic DNA

SEQ ID NO: 129093 - DNA, 30 bp, Homo sapiens; identical to SEQ ID NO: 98637
  misc_feature 1..30: note = chr8:12777147-12777177
  misc_feature 1..30: note = Hypo
  source 1..30: mol_type = genomic DNA

SEQ ID NO: 129094 - DNA, 68 bp, Homo sapiens; identical to SEQ ID NO: 98639
  misc_feature 1..68: note = chr8:12808843-12808911
  misc_feature 1..68: note = Hyper
  source 1..68: mol_type = genomic DNA

SEQ ID NO: 129095 - DNA, 152 bp, Homo sapiens; identical to SEQ ID NO: 98640
  misc_feature 1..152: note = chr8:12809647-12809799
  misc_feature 1..152: note = Hyper
  source 1..152: mol_type = genomic DNA

SEQ ID NO: 129096 - DNA, 30 bp, Homo sapiens; identical to SEQ ID NO: 98642
  misc_feature 1..30: note = chr8:12826740-12826770
  misc_feature 1..30: note = Hypo
  source 1..30: mol_type = genomic DNA

SEQ ID NO: 129097 - DNA, 86 bp, Homo sapiens; identical to SEQ ID NO: 41712
  misc_feature 1..86: note = chr8:12831656-12831742
  misc_feature 1..86: note = Hypo
  source 1..86: mol_type = genomic DNA

SEQ ID NO: 129098 - DNA, 29 bp, Homo sapiens
  misc_feature 1..29: note = chr8:12881832-12881861
  misc_feature 1..29: note = Hypo
  source 1..29: mol_type = genomic DNA
tgagccaccgcgcccggcctgttcctttt

SEQ ID NO: 129099 - DNA, 141 bp, Homo sapiens; identical to SEQ ID NO: 98657
  misc_feature 1..141: note = chr8:12949878-12950019
  misc_feature 1..141: note = Hypo
  source 1..141: mol_type = genomic DNA

SEQ ID NO: 129100 - DNA, 108 bp, Homo sapiens; identical to SEQ ID NO: 41714
  misc_feature 1..108: note = chr8:12952416-12952524
  misc_feature 1..108: note = Hypo
  source 1..108: mol_type = genomic DNA

SEQ ID NO: 129101 - DNA, 90 bp, Homo sapiens; identical to SEQ ID NO: 41715
  misc_feature 1..90: note = chr8:12956998-12957088
  misc_feature 1..90: note = Hypo
  source 1..90: mol_type = genomic DNA

SEQ ID NO: 129102 - DNA, 66 bp, Homo sapiens; identical to SEQ ID NO: 98660
  misc_feature 1..66: note = chr8:12957529-12957595
  misc_feature 1..66: note = Hypo
  source 1..66: mol_type = genomic DNA

SEQ ID NO: 129103 - DNA, 330 bp, Homo sapiens; identical to SEQ ID NO: 98661
  misc_feature 1..330: note = chr8:12989381-12989711
  misc_feature 1..330: note = Hyper
  source 1..330: mol_type = genomic DNA

SEQ ID NO: 129104 - DNA, 113 bp, Homo sapiens; identical to SEQ ID NO: 98662
  misc_feature 1..113: note = chr8:12990035-12990148
  misc_feature 1..113: note = Hyper
  source 1..113: mol_type = genomic DNA

SEQ ID NO: 129105 - DNA, 838 bp, Homo sapiens; identical to SEQ ID NO: 98663
  misc_feature 1..838: note = chr8:12990499-12991337
  misc_feature 1..838: note = Hyper
  source 1..838: mol_type = genomic DNA

SEQ ID NO: 129106 - DNA, 88 bp, Homo sapiens; identical to SEQ ID NO: 98664
  misc_feature 1..88: note = chr8:13003417-13003505
  misc_feature 1..88: note = Hypo
  source 1..88: mol_type = genomic DNA

SEQ ID NO: 129107 - DNA, 568 bp, Homo sapiens; identical to SEQ ID NO: 98682
  misc_feature 1..568: note = chr8:13133827-13134395
  misc_feature 1..568: note = Hyper
  source 1..568: mol_type = genomic DNA

SEQ ID NO: 129108 - DNA, 24 bp, Homo sapiens
  misc_feature 1..24: note = chr8:13319913-13319937
  misc_feature 1..24: note = Hypo
  source 1..24: mol_type = genomic DNA
tttttttttttgagacggagtctg

SEQ ID NO: 129109 - DNA, 16 bp, Homo sapiens
  misc_feature 1..16: note = chr8:13320204-13320220
  misc_feature 1..16: note = Hypo
  source 1..16: mol_type = genomic DNA
gcgcccggcctactat

SEQ ID NO: 129110 - DNA, 228 bp, Homo sapiens
  misc_feature 1..228: note = chr8:13424168-13424396
  misc_feature 1..228: note = Hyper
  source 1..228: mol_type = genomic DNA
tttgcaaggttttcccgttgactactcgactttagcaccaaagagaagcaggagtgcagaagacagggcaaaatcgccaacccggcgcaagcagcgcaagcgcagtgggcgctggggagcgcggaggaaaaggcgggacgccgcatggtggccagtcactgcgcatgagcggcccgcgttgccaagacagctgggaaggcgtctcccggaagacgacctccgcagagc

SEQ ID NO: 129111 - DNA, 30 bp, Homo sapiens; identical to SEQ ID NO: 41718
  misc_feature 1..30: note = chr8:13654931-13654961
  misc_feature 1..30: note = Hypo
  source 1..30: mol_type = genomic DNA

SEQ ID NO: 129112 - DNA, 101 bp, Homo sapiens; identical to SEQ ID NO: 99100
  misc_feature 1..101: note = chr8:14898126-14898227
  misc_feature 1..101: note = Hypo
  source 1..101: mol_type = genomic DNA

SEQ ID NO: 129113 - DNA, 426 bp, Homo sapiens
  misc_feature 1..426: note = chr8:15094345-15094771
  misc_feature 1..426: note = Hyper
  source 1..426: mol_type = genomic DNA
aggctggtgggagaccgtgtgcggccggagcctccgcagatgccgcccctaccagcccggctcccgcctccccgccccctgcccgagtccccggacctgctcccgcgcctggggctagggcaggctagccgtccccggcagcgggggtacctctccagcccctgcactgcaactgcgggaggaaacactgcccgcgggcggtgggagggaaaaggggtctcacgaagttctgggataaaaacgggctgtcgttgcagatgcctctgtcacgcgaatctccgagcggaaatgcactgtccccgtgccgggctggggcacaggcgggatcggagccgggaagaggaggcaaagtggcggcgcagctcggacaactttgctgggaaagcaggcgacagcgggcagagctggtgccgctgccccccccgg

SEQ ID NO: 129114 - DNA, 30 bp, Homo sapiens
  misc_feature 1..30: note = chr8:15095073-15095103
  misc_feature 1..30: note = Hyper
  source 1..30: mol_type = genomic DNA
ccgcccggacccgcacgtaccttgagctcc

SEQ ID NO: 129115 - DNA, 51 bp, Homo sapiens; identical to SEQ ID NO: 31802
  misc_feature 1..51: note = chr8:15095356-15095407
  misc_feature 1..51: note = Hyper
  source 1..51: mol_type = genomic DNA

SEQ ID NO: 129116 - DNA, 33 bp, Homo sapiens; identical to SEQ ID NO: 99107
  misc_feature 1..33: note = chr8:15171865-15171898
  misc_feature 1..33: note = Hypo
  source 1..33: mol_type = genomic DNA

SEQ ID NO: 129117 - DNA, 184 bp, Homo sapiens
  misc_feature 1..184: note = chr8:15397713-15397897
  misc_feature 1..184: note = Hyper
  source 1..184: mol_type = genomic DNA
ttcctgcccccatcccgcgcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggc

SEQ ID NO: 129118 - DNA, 130 bp, Homo sapiens; identical to SEQ ID NO: 99108
  misc_feature 1..130: note = chr8:15398217-15398347
  misc_feature 1..130: note = Hyper
  source 1..130: mol_type = genomic DNA

SEQ ID NO: 129119 - DNA, 53 bp, Homo sapiens; identical to SEQ ID NO: 99119
  misc_feature 1..53: note = chr8:16460002-16460055
  misc_feature 1..53: note = Hypo
  source 1..53: mol_type = genomic DNA

SEQ ID NO: 129120 - DNA, 30 bp, Homo sapiens; identical to SEQ ID NO: 99120
  misc_feature 1..30: note = chr8:16687802-16687832
  misc_feature 1..30: note = Hypo
  source 1..30: mol_type = genomic DNA

SEQ ID NO: 129121 - DNA, 26 bp, Homo sapiens
  misc_feature 1..26: note = chr8:16760265-16760291
  misc_feature 1..26: note = Hypo
  source 1..26: mol_type = genomic DNA
tcgctgggtaaaccacgtgaaaagaa

SEQ ID NO: 129122 - DNA, 367 bp, Homo sapiens; identical to SEQ ID NO: 99122
  misc_feature 1..367: note = chr8:16858724-16859091
  misc_feature 1..367: note = Hyper
  source 1..367: mol_type = genomic DNA

SEQ ID NO: 129123 - DNA, 135 bp, Homo sapiens; identical to SEQ ID NO: 99123
  misc_feature 1..135: note = chr8:16859352-16859487
  misc_feature 1..135: note = Hyper
  source 1..135: mol_type = genomic DNA

SEQ ID NO: 129124 - DNA, 1029 bp, Homo sapiens
  misc_feature 1..1029: note = chr8:16884323-16885352
  misc_feature 1..1029: note = Hyper
  source 1..1029: mol_type = genomic DNA
ctgaggtcaggagaccgttagggaatgtgagtgtcccagacgggcgctgagcccagctcggagacccaccccgcccgtagcagcggcgcgggccccagagagccccgcactcggccgcgcctcagttacgctgactcggctgtgcccgcagtgtcgcgctgtcgcgtagccaggtgtcgccgggctggcgcggttatttatgactgcgtggttgggctgggggttcggggccggggagcagccgggatccgccgcctcttccatgatcttcccgggccgaaccacgggaccgctacgctgaaggtggcgtcgcgggtccccggggccgcgcgagtgtaggggtcgctctcggccggccgcgaagctcgcggcaccgacttctcgcgagatttcggcgacccccccccccgcccccgcccctccgttctctgccccctcccagctctggtgtgggcggcctccgctatggctgcgctgcgaaggctcttgtggccgccaccccgggtgtctcctccactctgcgctcaccagcccctccttgggccgtgggggcggcctgcggtgaccaccctgggccttcctggccggcccttctcctcccgagaggatgaggagagggctgtggcggaggcggcatggaggcggcggcggcgctggggggagctgagcgtggcggcggcggccggcggggggctggtcggcctggtatgctaccagctgtacggggaccccagggccggctcgccggcgaccgggcgaccctcaaagagcgcggccacggagcccgaggacccgccccgcggccgggggatgctgcccatcccagtggcggctgccaaggagacggtgagtgcgcgagcgcgcgtcacacctgcgcgggggatgtgaccttcgtgccgggtacgcaggaccctggaggctgtggggacggtgcaagcgctgtggccgcgggtgaggaacttcccgtgagcgaggctgacacctaggccggacagcctaggatccggtcacccacgtattgggaagacc

SEQ ID NO: 129125 - DNA, 30 bp, Homo sapiens; identical to SEQ ID NO: 99126
  misc_feature 1..30: note = chr8:17003919-17003949
  misc_feature 1..30: note = Hypo
  source 1..30: mol_type = genomic DNA

SEQ ID NO: 129126 - DNA, 291 bp, Homo sapiens
  misc_feature 1..291: note = chr8:17270828-17271119
  misc_feature 1..291: note = Hyper
  source 1..291: mol_type = genomic DNA
gcgggcgcggcctcacgcacctgcgcgcctctgcggcgcgatgggaggggcgcggggagggggcttcgcgcccgggagtgggcgggacgcggtcttggctccgcccccaggtgttccgcgcgcggcgtgcggacccggggctcccgcgcggccctagagagcccacctccgcgcctgcgcccacctgcgccgccgccgcgacgcgcctctgcctggggttgccggggcgagggctgctcgctctctcttaacaggggcagccggcggagcactatacggccactgttctcc

SEQ ID NO: 129127 - DNA, 149 bp, Homo sapiens; identical to SEQ ID NO: 99128
  misc_feature 1..149: note = chr8:17354451-17354600
  misc_feature 1..149: note = Hyper
  source 1..149: mol_type = genomic DNA

SEQ ID NO: 129128 - DNA, 47 bp, Homo sapiens; identical to SEQ ID NO: 99129
  misc_feature 1..47: note = chr8:17659282-17659329
  misc_feature 1..47: note = Hyper
  source 1..47: mol_type = genomic DNA

SEQ ID NO: 129129 - DNA, 84 bp, Homo sapiens; identical to SEQ ID NO: 99134
  misc_feature 1..84: note = chr8:17974435-17974519
  misc_feature 1..84: note = Hypo
  source 1..84: mol_type = genomic DNA

SEQ ID NO: 129130 - DNA, 30 bp, Homo sapiens; identical to SEQ ID NO: 99135
  misc_feature 1..30: note = chr8:18062915-18062945
  misc_feature 1..30: note = Hypo
  source 1..30: mol_type = genomic DNA

SEQ ID NO: 129131 - DNA, 40 bp, Homo sapiens; identical to SEQ ID NO: 99137
  misc_feature 1..40: note = chr8:18244635-18244675
  misc_feature 1..40: note = Hyper
  source 1..40: mol_type = genomic DNA

SEQ ID NO: 129132 - DNA, 41 bp, Homo sapiens; identical to SEQ ID NO: 99139
  misc_feature 1..41: note = chr8:18806532-18806573
  misc_feature 1..41: note = Hypo
  source 1..41: mol_type = genomic DNA

SEQ ID NO: 129133 - DNA, 30 bp, Homo sapiens; identical to SEQ ID NO: 99140
  misc_feature 1..30: note = chr8:18870173-18870203
  misc_feature 1..30: note = Hyper
  source 1..30: mol_type = genomic DNA

SEQ ID NO: 129134 - DNA, 144 bp, Homo sapiens; identical to SEQ ID NO: 99141
  misc_feature 1..144: note = chr8:18871433-18871577
  misc_feature 1..144: note = Hyper
  source 1..144: mol_type = genomic DNA

SEQ ID NO: 129135 - DNA, 18 bp, Homo sapiens
  misc_feature 1..18: note = chr8:19016279-19016297
  misc_feature 1..18: note = Hypo
  source 1..18: mol_type = genomic DNA
aaggaagaagtgggccgg

SEQ ID NO: 129136 - DNA, 37 bp, Homo sapiens; identical to SEQ ID NO: 99143
  misc_feature 1..37: note = chr8:19170992-19171029
  misc_feature 1..37: note = Hyper
  source 1..37: mol_type = genomic DNA

SEQ ID NO: 129137 - DNA, 1257 bp, Homo sapiens
  misc_feature 1..1257: note = chr8:19614007-19615264
  misc_feature 1..1257: note = Hyper
  source 1..1257: mol_type = genomic DNA
caggtgcaggaagtgcgacggaaacaaacaactttgcctccgcttcctacagctttcctctcctccccgcccttctagcccccatcccaccccaagatcatgccctcgaacagcttctgcccaccgatcgcacgtcccctgggcatgttcgggcagcggtgaccctcagccacatcccccactagcccggtcccgggcaggcgagcgcgctgcccaccggccaccctcgtcacgccccctccaccctctccatcccagccacaataatacaataaccgcagtcatcgcgcggcacgtggaaaggctacttttcagtgggttttgcagaaagcaatcagacagcggaaggccacgagaaacgctggtgaagccaaaccgaccccgggagcgcagcggccccggaccctccctggaagctccctccgcgtccccgcgcgcccacctggaggcgccgcgccctccgcctgccaagccggtccccggcccctgcccgtgccctgggcccccggcgggcagcggcggagggaggccaggcgcggcaccgtcctccgcagctgcacgagccaccccgaggtcgcggggtgggcgggcgcgagctaggcgcgcggggctgtggggatctgccggcgccactgacgcccccgcgcggcacaccgcgcccggctggcccgggaggggacccgactcacccgaagcgccctgctagctgcccggcccggctccggccgctgccgccgtcgctgaactttccctcctgcgcggccgccgcggactcggctccacctcccgctccggcagccgcggagcctccagggaccccgggggcggggagcagcggcggcggcggcggctcgggcgggcgggcgcaacagcggccaagcctggcgccccgccgcagggtaggtccggcgggggcggccaaggccgggctggggtcgcggttggccgcgtacctccgcgtcacccacggcctctctgcagtgcgtccctgcgcccgtcggagcggcgccctggccgaagcctgtcactctcggaaggggccgcgctcggacaccaggggcggtttacgcgtgactggacaccaagagccggagaagtttagagactaggacactgtggcgtggcccgagttgcaggagagaggtgtccaatctccatggggtccttactcttgcaggacagagttccccatccccctgctccacccgctctgttcccttggctgccctccccgccgagcgccgacttccatgcaaa

SEQ ID NO: 129138 - DNA, 529 bp, Homo sapiens
  misc_feature 1..529: note = chr8:19797490-19798019
  misc_feature 1..529: note = Hyper
  source 1..529: mol_type = genomic DNA
ccccgcccggggactcgcgggccgactgtggccccttctggggaagccggggcgcggggaggcgttccgggcatctcagccgcacggggtacgctcgccctcggcggggcccctcgctccgctgtgggagtggcagtgggtgtcggggtggagaaagtacgcgtggcgcggagtcctggggacgcggcgtcccacccgctctggggagccccggactctctccagcttccaggctcgcatgcccctcttttcttagtgccctgagaacccagcgaggggctgaccctcccgaaaccgtggcgcagccaccagcaatctgtggtcgccgactcggggggttgccaggtctgcgtttggccaccctttctgtcctgggggctgaggtcagctccgggcgcccggccccgccgcgcggctgcgagcacgtggggttgacgggcgccgcgtggaggcagcgagcacaacggtggtcaccgccgccagggaaccgcccgctcgctggggtccaggcgttcggggccaaatgaga

SEQ ID NO: 129139 - DNA, 34 bp, Homo sapiens; identical to SEQ ID NO: 99151
  misc_feature 1..34: note = chr8:20110445-20110479
  misc_feature 1..34: note = Hypo
  source 1..34: mol_type = genomic DNA

SEQ ID NO: 129140 - DNA, 972 bp, Homo sapiens
  misc_feature 1..972: note = chr8:20160762-20161734
  misc_feature 1..972: note = Hyper
  source 1..972: mol_type = genomic DNA
cggtgtcctccccaccggtgtggacacagctcatctgcaaagttccaggcggcgaagttcagcggcccggaccgaccgccggaccctcttcctgcggcccctgctcctgcggcctcgcgtccccacctcccacttcttcacctccgacaccagtgtcacctaacactgacgtccccgccaggatcagcatcggtgctgggaatagacgaaccccgtctgcaggagacacgaagacaaagacaggaggacagacgcacagtcacctcctctgggccgggccggagaagcggcgcccaccctgcagaggggagaccctgacagctccacgcggagacaaagacacctcgacagccacggacacagacagacaaagaccgacggacgcgcggacgcacggacggtccggcccggcgaggggaaagcggtttcccgcagccagggcagcagaccctccaggggcgaggagatccccggccaccgcaccttacctgccccctgcgcctcgggcgcacttgagactttttttttttcccagtgtttcccggtgtgttcccgtctctctttttccagagctgctgagcgggccgggccggtcccactgcgcgggatgcagctcccggctcccactcactggccgaggcgggcagagaaactttcggcctccccgcccggccgctgccaacccgccagctccaggcgcgccggcctctgcgcgggtcccggagccggggcggggcggggcggggcggggcggggcggggccggcccggggcggggccagagccggcgccgctgattggcagcgagctgccggcagcctggtctgtgccgctcggcggcctttgttccgggctgacagctggggctgctcgcgacctcgcggctccttcgcgcccgcggcctgcgcggggtcccgggtcccgtctctctgctctcacttccatcagccccattgggcgaccctgccccctc

SEQ ID NO: 129141 - DNA, 37 bp, Homo sapiens; identical to SEQ ID NO: 99154
  misc_feature 1..37: note = chr8:20317340-20317377
  misc_feature 1..37: note = Hypo
  source 1..37: mol_type = genomic DNA

SEQ ID NO: 129142 - DNA, 36 bp, Homo sapiens; identical to SEQ ID NO: 99155
  misc_feature 1..36: note = chr8:20317437-20317473
  misc_feature 1..36: note = Hypo
  source 1..36: mol_type = genomic DNA

SEQ ID NO: 129143 - DNA, 130 bp, Homo sapiens; identical to SEQ ID NO: 99156
  misc_feature 1..130: note = chr8:20431789-20431919
  misc_feature 1..130: note = Hypo
  source 1..130: mol_type = genomic DNA

SEQ ID NO: 129144 - DNA, 63 bp, Homo sapiens; identical to SEQ ID NO: 99157
  misc_feature 1..63: note = chr8:21302252-21302315
  misc_feature 1..63: note = Hypo
  source 1..63: mol_type = genomic DNA

SEQ ID NO: 129145 - DNA, 173 bp, Homo sapiens; identical to SEQ ID NO: 41723
  misc_feature 1..173: note = chr8:21393876-21394049
  misc_feature 1..173: note = Hypo
  source 1..173: mol_type = genomic DNA

SEQ ID NO: 129146 - DNA, 64 bp, Homo sapiens; identical to SEQ ID NO: 99159
  misc_feature 1..64: note = chr8:21546878-21546942
  misc_feature 1..64: note = Hypo
  source 1..64: mol_type = genomic DNA

SEQ ID NO: 129147 - DNA, 183 bp, Homo sapiens; identical to SEQ ID NO: 99160
  misc_feature 1..183: note = chr8:21563318-21563501
  misc_feature 1..183: note = Hypo
  source 1..183: mol_type = genomic DNA

SEQ ID NO: 129148 - DNA, 79 bp, Homo sapiens; identical to SEQ ID NO: 99161
  misc_feature 1..79: note = chr8:21585266-21585345
  misc_feature 1..79: note = Hypo
  source 1..79: mol_type = genomic DNA

SEQ ID NO: 129149 - DNA, 170 bp, Homo sapiens; identical to SEQ ID NO: 99162
  misc_feature 1..170: note = chr8:21608043-21608213
  misc_feature 1..170: note = Hypo
  source 1..170: mol_type = genomic DNA

SEQ ID NO: 129150 - DNA, 135 bp, Homo sapiens; identical to SEQ ID NO: 99163
  misc_feature 1..135: note = chr8:21842170-21842305
  misc_feature 1..135: note = Hypo
  source 1..135: mol_type = genomic DNA

SEQ ID NO: 129151 - DNA, 77 bp, Homo sapiens; identical to SEQ ID NO: 99164
  misc_feature 1..77: note = chr8:21868044-21868121
  misc_feature 1..77: note = Hyper
  source 1..77: mol_type = genomic DNA

SEQ ID NO: 129152 - DNA, 334 bp, Homo sapiens; identical to SEQ ID NO: 99165
  misc_feature 1..334: note = chr8:21881693-21882027
  misc_feature 1..334: note = Hyper
  source 1..334: mol_type = genomic DNA

SEQ ID NO: 129153 - DNA, 30 bp, Homo sapiens; identical to SEQ ID NO: 99166
  misc_feature 1..30: note = chr8:21927030-21927060
  misc_feature 1..30: note = Hypo
  source 1..30: mol_type = genomic DNA

SEQ ID NO: 129154 - DNA, 30 bp, Homo sapiens; identical to SEQ ID NO: 99167
  misc_feature 1..30: note = chr8:21959580-21959610
  misc_feature 1..30: note = Hypo
  source 1..30: mol_type = genomic DNA

SEQ ID NO: 129155 - DNA, 44 bp, Homo sapiens; identical to SEQ ID NO: 99168
  misc_feature 1..44: note = chr8:21987424-21987468
  misc_feature 1..44: note = Hyper
  source 1..44: mol_type = genomic DNA

SEQ ID NO: 129156 - DNA, 214 bp, Homo sapiens; identical to SEQ ID NO: 99169
  misc_feature 1..214: note = chr8:21987861-21988075
  misc_feature 1..214: note = Hyper
  source 1..214: mol_type = genomic DNA

SEQ ID NO: 129157 - DNA, 56 bp, Homo sapiens; identical to SEQ ID NO: 99170
  misc_feature 1..56: note = chr8:21988412-21988468
  misc_feature 1..56: note = Hyper
  source 1..56: mol_type = genomic DNA

SEQ ID NO: 129158 - DNA, 37 bp, Homo sapiens; identical to SEQ ID NO: 99171
  misc_feature 1..37: note = chr8:22005505-22005542
  misc_feature 1..37: note = Hypo
  source 1..37: mol_type = genomic DNA

SEQ ID NO: 129159 - DNA, 62 bp, Homo sapiens; identical to SEQ ID NO: 99172
  misc_feature 1..62: note = chr8:22013920-22013982
  misc_feature 1..62: note = Hyper
  source 1..62: mol_type = genomic DNA

SEQ ID NO: 129160 - DNA, 133 bp, Homo sapiens; identical to SEQ ID NO: 99173
  misc_feature 1..133: note = chr8:22089510-22089643
  misc_feature 1..133: note = Hyper
  source 1..133: mol_type = genomic DNA

SEQ ID NO: 129161 - DNA, 17 bp, Homo sapiens
  misc_feature 1..17: note = chr8:22101764-22101781
  misc_feature 1..17: note = Hypo
  source 1..17: mol_type = genomic DNA
tacgacaactctgtgaa

SEQ ID NO: 129162 - DNA, 30 bp, Homo sapiens; identical to SEQ ID NO: 99175
  misc_feature 1..30: note = chr8:22297450-22297480
  misc_feature 1..30: note = Hypo
  source 1..30: mol_type = genomic DNA

SEQ ID NO: 129163 - DNA, 43 bp, Homo sapiens; identical to SEQ ID NO: 99176
  misc_feature 1..43: note = chr8:22549491-22549534
  misc_feature 1..43: note = Hyper
  source 1..43: mol_type = genomic DNA

SEQ ID NO: 129164 - DNA, 625 bp, Homo sapiens
  misc_feature 1..625: note = chr8:22562064-22562689
  misc_feature 1..625: note = Hyper
  source 1..625: mol_type = genomic DNA
tagtcattaaaggaccgagtctgaataagtaggtctgtgttttggtccagctatggcctcacgtactgggtgccctttgaaaaattctatgtaaacagaatttttgttaaaaaaaaaaaaagcgtcaaagttcacaagggaaagtctggtctctgaaggcaaagtcacctgcgacatgtcccttacccccggcatcagcccctcttcccctgggtgggctttgccgccctgccaccaggtggcctgagatgaaattctgacagtgagtgaggacagggttgttttcagaagccagccgtggggagagatggcagcggaagaagggtgactgccgtcgcgctgtgggtcccccagccccaaatctcagagccgcactcccctctcacacaaacactctctccaagcggtaggaaaggtgcttctagaccccaaacgaaagaaaaagtatgccgcaatggaaactcgaactaatcttcccctcttgccccacttccctcccgcggtcacacttccggcggccaccacagggtattttgggtttgaaaacaaagcgtcagatctatttgagcaacttttgttccattggagtagaagcccaggggcctgtggccgctctgggctcggc

SEQ ID NO: 129165 - DNA, 30 bp, Homo sapiens; identical to SEQ ID NO: 9416
  misc_feature 1..30: note = chr8:22613837-22613867
  misc_feature 1..30: note = Hyper
  source 1..30: mol_type = genomic DNA

SEQ ID NO: 129166 - DNA, 30 bp, Homo sapiens; identical to SEQ ID NO: 99179
  misc_feature 1..30: note = chr8:22694146-22694176
  misc_feature 1..30: note = Hypo
  source 1..30: mol_type = genomic DNA

SEQ ID NO: 129167 - DNA, 30 bp, Homo sapiens; identical to SEQ ID NO: 99180
  misc_feature 1..30: note = chr8:22708858-22708888
  misc_feature 1..30: note = Hypo
  source 1..30: mol_type = genomic DNA

SEQ ID NO: 129168 - DNA, 235 bp, Homo sapiens; identical to SEQ ID NO: 99181
  misc_feature 1..235: note = chr8:22722223-22722458
  misc_feature 1..235: note = Hyper
  source 1..235: mol_type = genomic DNA

SEQ ID NO: 129169 - DNA, 69 bp, Homo sapiens; identical to SEQ ID NO: 99182
  misc_feature 1..69: note = chr8:22723292-22723361
  misc_feature 1..69: note = Hyper
  source 1..69: mol_type = genomic DNA

SEQ ID NO: 129170 - DNA, 184 bp, Homo sapiens; identical to SEQ ID NO: 99183
  misc_feature 1..184: note = chr8:22760486-22760670
  misc_feature 1..184: note = Hypo
  source 1..184: mol_type = genomic DNA

SEQ ID NO: 129171 - DNA, 438 bp, Homo sapiens; identical to SEQ ID NO: 99184
  misc_feature 1..438: note = chr8:22960583-22961021
  misc_feature 1..438: note = Hyper
  source 1..438: mol_type = genomic DNA

SEQ ID NO: 129172 - DNA, 417 bp, Homo sapiens
  misc_feature 1..417: note = chr8:23021173-23021590
  misc_feature 1..417: note = Hyper
  source 1..417: mol_type = genomic DNA
ctgcccagacatgcccggccgcaggcgacccgggccaagcatccccaccgtgtccccctctctccctgcccactcccggcgccaggtgcgctcttccccagccagggaccgcggcggagactcaccggcagcagaaccgcgacgatgaagacgacgaacttaaggatcttggggtccaggagccatggtctggttcccgacgctgtcctggctcctggatagcgccctgctcgagcgctcgaggcggtcgggacgctttgtccccaaagtcccatgagaagggaggagggtggatcgaaagcgccaaaaatcaatcagaaatcgtccccgtagtttgtgcgcgtgcaaaggttctcgcagctacactgccagaatagaacgtgctcctccgcttttataccccggaaaaaaggcgtg

SEQ ID NO: 129173 - DNA, 579 bp, Homo sapiens; identical to SEQ ID NO: 99186
  misc_feature 1..579: note = chr8:23260467-23261046
  misc_feature 1..579: note = Hyper
  source 1..579: mol_type = genomic DNA

SEQ ID NO: 129174 - DNA, 552 bp, Homo sapiens; identical to SEQ ID NO: 99187
  misc_feature 1..552: note = chr8:23261347-23261899
  misc_feature 1..552: note = Hyper
  source 1..552: mol_type = genomic DNA

SEQ ID NO: 129175 - DNA, 254 bp, Homo sapiens; identical to SEQ ID NO: 99188
  misc_feature 1..254: note = chr8:23290404-23290658
  misc_feature 1..254: note = Hypo
  source 1..254: mol_type = genomic DNA

SEQ ID NO: 129176 - DNA, 30 bp, Homo sapiens; identical to SEQ ID NO: 41728
  misc_feature 1..30: note = chr8:23331189-23331219
  misc_feature 1..30: note = Hypo
  source 1..30: mol_type = genomic DNA

SEQ ID NO: 129177 - DNA, 30 bp, Homo sapiens; identical to SEQ ID NO: 41729
  misc_feature 1..30: note = chr8:23340639-23340669
  misc_feature 1..30: note = Hypo
  source 1..30: mol_type = genomic DNA

SEQ ID NO: 129178 - DNA, 30 bp, Homo sapiens; identical to SEQ ID NO: 99191
  misc_feature 1..30: note = chr8:23345865-23345895
  misc_feature 1..30: note = Hypo
  source 1..30: mol_type = genomic DNA

SEQ ID NO: 129179 - DNA, 136 bp, Homo sapiens; identical to SEQ ID NO: 99192
  misc_feature 1..136: note = chr8:23380707-23380843
  misc_feature 1..136: note = Hypo
  source 1..136: mol_type = genomic DNA

SEQ ID NO: 129180 - DNA, 30 bp, Homo sapiens; identical to SEQ ID NO: 41731
  misc_feature 1..30: note = chr8:23395420-23395450
  misc_feature 1..30: note = Hypo
  source 1..30: mol_type = genomic DNA

SEQ ID NO: 129181 - DNA, 38 bp, Homo sapiens; identical to SEQ ID NO: 15103
  misc_feature 1..38: note = chr8:23399594-23399632
  misc_feature 1..38: note = Hypo
  source 1..38: mol_type = genomic DNA

SEQ ID NO: 129182 - DNA, 152 bp, Homo sapiens; identical to SEQ ID NO: 15104
  misc_feature 1..152: note = chr8:23423918-23424070
  misc_feature 1..152: note = Hypo
  source 1..152: mol_type = genomic DNA

SEQ ID NO: 129183 - DNA, 30 bp, Homo sapiens; identical to SEQ ID NO: 99196
  misc_feature 1..30: note = chr8:23424483-23424513
  misc_feature 1..30: note = Hypo
  source 1..30: mol_type = genomic DNA

SEQ ID NO: 129184 - DNA, 53 bp, Homo sapiens; identical to SEQ ID NO: 99197
  misc_feature 1..53: note = chr8:23430870-23430923
  misc_feature 1..53: note = Hypo
  source 1..53: mol_type = genomic DNA

SEQ ID NO: 129185 - DNA, 1584 bp, Homo sapiens
  misc_feature 1..1584: note = chr8:23559338-23560922
  misc_feature 1..1584: note = Hyper
  source 1..1584: mol_type = genomic DNA
ttccaggagagcagtcgtggccagaaaagagtgctcctctggattaacggagtcccctggggcgcggccttatggggatgtttaagtcccaaaggaagaggctcaaagcaggttactcttcgtgaacttcccggatcctcaagttcccagctcttcagcccccttcccgccctcccgtcctcttctctttcttccccaacagctgtcattaattggaggatggtaggcccgctagatcaccatctccattcaccgccgatgccccggggctgctgcgtacagatgcaagagcctctcgggcctctggggttgaagccccaaaagtcacgcgccttagtactgctcccacaccccaaactgccagccagccttggtgttcttcagtccctgtgttgcttggtgggtgaccggtggaggggtcttcttttgggggaagaacgtcccaggcggggcctttaactgggtgactgtggtgcagatcgcagtttcagagatccctccggaaagaagcgccgttgggtagcagcttccttccagcgccgcgtcccctccttgtcacgacctgcgggcggaggggaagggaacgagcatctggccctggttggcagagtcaagccgaggagcctcaccaggccctgacaccctgcagcgtggctgccagatggccctgcggggtggcattctggccaccgtgtccgaagcccgcgctggccagtggtgtgtgtggcgcaggacccgagggcgcgcccgcgtagcaggtgccgtagcctgcgccgtagggtgctccgctgtagcctccgtagcaagagtagggcgacactgctgcactgtaggggctggggaaggcaggtgcgccgggcccggggcccaggcagggcttgccatcgcgcaccaggacgggcacagctactcggcgcggcgttagagggtggccagccagttccagcgacttgtcctggcgctgtctcttgcatttgtagcgtcggttctggaaccagatcttgacctgcgtggacgtgagctgcagcgcgctggccaggtgctcgcgctcgggcgctgacaggtaccgctgctgcttgaagcgccgctccagggccagcacctgcgcctgcgaaaagagcacgcgcggcttccgtcgttgccgcgccttgggctgctccgagcggccaccccgcacgctgtcgccgctgttgccaacgccgcgctctggcaccctggtcccgccgccgaggggcgaggccgcgttcaggccgggctctaaaagcacaggaagggacacatcagcgcccagcctaaggctcacctgagcggttcctacttagttttcaagactttcctctccctggcagccttcactctgcgcaggctcctcctccctcctactgcccccgaaccctgtcccaggacgaaccctgtcccaggactgtctccatgttttttccctccaagctctgtcacctttatatgttactgctggaacataaattgtgacaacctatggtccctcgtgtgtgcgtccttttcctaaaggtagactctagataaagagttaaggcagctccatttgcttcttagaatgtgtgt

SEQ ID NO: 129186 - DNA, 30 bp, Homo sapiens; identical to SEQ ID NO: 99200
  misc_feature 1..30: note = chr8:23562792-23562822
  misc_feature 1..30: note = Hyper
  source 1..30: mol_type = genomic DNA

SEQ ID NO: 129187 - DNA, 93 bp, Homo sapiens
  misc_feature 1..93: note = chr8:23563061-23563154
  misc_feature 1..93: note = Hyper
  source 1..93: mol_type = genomic DNA
cgcaacacaactccccgccagccccttcccttccagcgggctggacacaggtgcgtgggcctcgcagcccggcgcgcacggttgcgcctttgg

SEQ ID NO: 129188 - DNA, 619 bp, Homo sapiens
  misc_feature 1..619: note = chr8:23563791-23564410
  misc_feature 1..619: note = Hyper
  source 1..619: mol_type = genomic DNA
cccccacattccccccgtaggaggcaagacctgagcgcttactcacgtggctcccccatccgttccgcgtccatctccaagactgcctcacagggacccccaggaggctccgaaccatccagctttctgtcaccgccgccgccaccagcgttgtgaacctctgaccctcgcggctctgcgtccattctcaggtactgaaagttttccgggctcttccgcacccgcggatgtggcgaagccgcggggcagctccgctcgcgctccagtcgcaggatgtccttgaccgagaagggggtggaggtgacggggctcagcagcatcccgaaggcggatggggcggggccgaggaggtccgggtgaggagcggcaccctgaacttcccgtcttgtcgctgcaggccccgcagacagacccaagctctgggacagacgcccagcgtcccagacagcgccttcctctgggccatgctggtaggcccgggtccagggccgggtgacgagaccgtagccccccattggttctcgcagaaaccacgtgctagctctgcaccttcctcccccagcgctttcttcccgcgcccgtcgaatcctctccagtccccagtcgccttcctgggagg

SEQ ID NO: 129189 - DNA, 490 bp, Homo sapiens; identical to SEQ ID NO: 99203
  misc_feature 1..490: note = chr8:23564781-23565271
  misc_feature 1..490: note = Hyper
  source 1..490: mol_type = genomic DNA

SEQ ID NO: 129190 - DNA, 979 bp, Homo sapiens
  misc_feature 1..979: note = chr8:23566803-23567782
  misc_feature 1..979: note = Hyper
  source 1..979: mol_type = genomic DNA
gtttacaatcatcaccgggcacccacaagagaccctgaacttagaatatttccgcggtaggagttccgcctcgtccttccaggggatactgacgactcgctgggttctcgccttccaagtgctggaggggggaagtagggccacccggggtagaaacctaacgccagaaaccttccagcgccttatcagttggtggaattttcgtggcagacagtcgcgctctacctaagtcgtagaagaaaagacaccttgtgggggacttggcgtcggaagccttgagttcaaatcgtagccctaggtccccagccttgcccttcctggcttgctgcgaggatgaaatgagatttttgtacgtgaaaatgctttctaacccctctcgaggggtggaaacgtctccattcgaccagagtccgggtctgcggagcaatttacccgccgctttccaagagcaggctccccagcgtagcgagtccttgttatggaaagggtcgtttcggctcaggatgcgcgctcccggcgtagacctggggataggggtccctgtcgcgctcgccccacccctgcagggagcaaggccgtccttctgcagcaccgcgccacgcggcgggaatttgcagtgtcctgctttctggtttcagcttcttcgctcgcttgggtctctctcggtcacctctcggaggggcctggagtccctcctccctcctcctacttcagcgccagaagcattgaaagccgcccgcccgccgagagtggaaccggtacctcgaatctcgctcattccgggtcaattggaggcgcattagcggctgccttgcagtgcaacagaggctcgagtgacaggccacctgcctaagcgctggcgcccaggaaagccggggaggaaactaggaagggaggcgacagcagaaaagccagagagtccagagactcctaggcaggcctccgtgcagccccaacagcgtggtgccgggaggtgtgt

SEQ ID NO: 129191 - DNA, 18 bp, Homo sapiens
  misc_feature 1..18: note = chr8:23567842-23567860
  misc_feature 1..18: note = Hyper
  source 1..18: mol_type = genomic DNA
catcgtgatcacctctgt

SEQ ID NO: 129192 - DNA, 630 bp, Homo sapiens
  misc_feature 1..630: note = chr8:23571643-23572273
  misc_feature 1..630: note = Hyper
  source 1..630: mol_type = genomic DNA
attaaggatctgatacgatcttttcctaaattgctatgctgaggcctttttgacggtttgtccgccatcactttcagaggcgctccgcgcgaaccccgaaaatctgtgcaaaattctcagggttaggggaagagcatgggtggagagtaaagtgaagcgggccgagagatttcttgcattaaatgtttagaagaaccaaccagttaaaggaaataaaaatctgccggtatgtaaccgctgggtgggcttctccatttctccgtgtcaccctcccccagccggcctcttagcttctcggctttgggtggcggagaccgtttagttctgggacagaccgtcgggggctgactccgggggtttgcgggcgccgagctgcctccgcgcgcgttccactccttcagcgtggaaaagaaaaccctcagcggccagagaggcggcggggccttcccggatcgctgattcggggagccgcaggcggggacgctgctgggcgacgcttatctgcgccgcgctcgccagctccgtttcaattaacattccagtgccgccgcccgccgcgggagcggagtccccaccagcccctggaaaaataaactctaggcctagcggctgtgcgtgcgtgtgtgtgtg

SEQ ID NO: 129193 - DNA, 329 bp, Homo sapiens; identical to SEQ ID NO: 99211
  misc_feature 1..329: note = chr8:23572333-23572662
  misc_feature 1..329: note = Hyper
  source 1..329: mol_type = genomic DNA

SEQ ID NO: 129194 - DNA, 850 bp, Homo sapiens
  misc_feature 1..850: note = chr8:23583971-23584821
  misc_feature 1..850: note = Hyper
  source 1..850: mol_type = genomic DNA
tacctcttattgcagcggggatactaaggccgggacaacaaaagtacgtcgctgactcgaagctgggcggcgggtttcagaggctgagttcttaacaccagggcacttccttgtagccaccacgcccggctgcatcctccacccggccggtttctagaaataggagataccgagaagttagggtggcccaggtctggccttagatctgcagaggggcgagtgcagattgcgcgatggcgaggctcctgcgacaaggcgaacaccaaggacgcgagctatctggaaccacaaataaaacaaattcagggacggcgttgacaccgcggccacctcctaggcgcttcttggaagggcgcggctgtggtgcccgctctgcccgtggtcccgcttacttttggactctgtcccccatggggctggggtccgggtccgcgccctgacccccgcctccgccgtcagtctctctccgctcccagccgggtggcgccgcagggggtggggttgttttcgtttggccccggggacgtccttgtcattccaacagcctcccggtgcggcccaaacaccctgggccacccgacacctcgcgctgttgacgacgcggggccgccggcgccagggcgggtggtggagctccgcgcaggccggggggaaccgcaagaggagccggggcgggcggcggccccgggcgggtcaggggcggcgcgagcccacacagagcggtgaaactaccaggggccctcccactcttcccggactccggaggagctaagccggcagggatcgctcgcccaccctgagcactttacctgcatggtggccaagacccttcgtccggaccctactcctg

SEQ ID NO: 129195 - DNA, 49 bp, Homo sapiens; identical to SEQ ID NO: 99215
  misc_feature 1..49: note = chr8:23585236-23585285
  misc_feature 1..49: note = Hyper
  source 1..49: mol_type = genomic DNA

SEQ ID NO: 129196 - DNA, 30 bp, Homo sapiens; identical to SEQ ID NO: 99216
  misc_feature 1..30: note = chr8:24272681-24272711
  misc_feature 1..30: note = Hyper
  source 1..30: mol_type = genomic DNA

SEQ ID NO: 129197 - DNA, 288 bp, Homo sapiens
  misc_feature 1..288: note = chr8:24770293-24770581
  misc_feature 1..288: note = Hyper
  source 1..288: mol_type = genomic DNA
gggtgacaagccccccgggtggctgcacctcccactcgccgacctgggcgctgtccttggtgctgccggcgccatagcgagcacaagcgccttaccttctgcccctgcggaagctgcggacgtcccccaaacgttaaaaacgccatatcccactttttatacaaataactaccccggcctgttctctttgtccccttcccgaagccttcaggcagaccgttccgcaaagtctttttttttgttttgttttgtcttctagacccagctcctcggcgctcatctccagct

SEQ ID NO: 129198 - DNA, 719 bp, Homo sapiens
  misc_feature 1..719: note = chr8:24770893-24771612
  misc_feature 1..719: note = Hyper
  source 1..719: mol_type = genomic DNA
aggggaccactgggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaag

SEQ ID NO: 129199 - DNA, 137 bp, Homo sapiens; identical to SEQ ID NO: 99222
  misc_feature 1..137: note = chr8:24772604-24772741
  misc_feature 1..137: note = Hyper
  source 1..137: mol_type = genomic DNA

SEQ ID NO: 129200 - DNA, 61 bp, Homo sapiens
  misc_feature 1..61: note = chr8:24799494-24799555
  misc_feature 1..61: note = Hyper
  source 1..61: mol_type = genomic DNA
atccgtaggaggccccgccccgcctcccggtggcctggtgctgggccgccctccccctctt

SEQ ID NO: 129201 - DNA, 68 bp, Homo sapiens; identical to SEQ ID NO: 99224
  misc_feature 1..68: note = chr8:24812768-24812836
  misc_feature 1..68: note = Hyper
  source 1..68: mol_type = genomic DNA

SEQ ID NO: 129202 - DNA, 1288 bp, Homo sapiens
  misc_feature 1..1288: note = chr8:24813140-24814428
  misc_feature 1..1288: note = Hyper
  source 1..1288: mol_type = genomic DNA
cgtcggtgttcttggcggcgctctcggtcagcacggtgaagcggctcttgaaccattcctcagcgttctgcatgttcttggcggccagcttctcgtactgcgcgcggatgtccttgagcgcggcggaaaggtcgggcttggtcacgtccatctccacggagatctgcgcgtactggatctgcgcctgcagttcggcgatctcctcttcgtgcactttcttcagaaaagagatttcgtccatcaagctgtcgatgcgcttctcgagctcggcgcgagcgagcgccgcctcgtcggcgcctttgcgcgcttccatcagccggccctcggcgtcctcgcggctcagcacctcctcttcatagcgcgcctgcaggttgcgcagggtctcctccagcccttcgcgctcgccctggagcgcctgcttctcgttggtggcatcttccgccgccaggcgcaggtcgcggatctcctgctcgtacagcgcccggaagcgggatggctcggagtgcttctggcgcagcaccagcagctcggcttccaggaccttgttctgctgctccagctcgtgcacgcgctcgatgaagctggcgaagcggtcattgaggtcctggagctgcgccttctcctgcgtgcggatggacttgaggtcgttgctgatggcggctacctggctcaggtcgaggttctccagactgggcatcaacgatccagagctggaggagtagctgcggcgcacggacagcgaggaagacaccggcgccgagtagctggagtaagctgagcgtgcggtgctgtagccgctgcgcacgctggagatgtgcacccggggcgtctccacgtagcgccgcttgtaggaggtcgagtagtacggctcgtagctgaaggaactcatggtggcggccggtggctccccggcccgcggcggcggtgggagcccggagagagaggacaggggagagagggaagggggaggatggatggctgtgtgcggctcggcgccgttctgccacccctatttatacgccgggaggctcctgacgcagcctgcgatcgatcacggcacgccggccagtgggggcagcgcgctgctgcagccaaggcgaggattctgcgcaaaagggaaggcggggtcgagctacggcccgaggagctgcggcggtcgtcctttccactttgctcagagggccctgattttctctgagatcccatgccccctcactcatttcccttctgtactcactcacgcagcccctcccgtcctgcattgcccagaccccgtgacacttggatc

SEQ ID NO: 129203 - DNA, 375 bp, Homo sapiens; identical to SEQ ID NO: 99228
  misc_feature 1..375: note = chr8:24815060-24815435
  misc_feature 1..375: note = Hyper
  source 1..375: mol_type = genomic DNA

SEQ ID NO: 129204 - DNA, 328 bp, Homo sapiens
  misc_feature 1..328: note = chr8:24816391-24816719
  misc_feature 1..328: note = Hyper
  source 1..328: mol_type = genomic DNA
tgaagcctttgactgcagaggaggctgcccagaaaggagaggggcggcgggtgctgcagagggatgcttcagagagaagaaaccattggggcacctgctgcctgccgtcccctgggtagctggaaaaaagaggaacacaggagcaaagggtgagaatgggaccctttcctgtgctgaacccggcccacagagtgggggaaggggcagatccacagcgtttaggcttatcgatctctggtctttttaaatatctcctggcctggccacctcatactccacgacagccttgctttgcaggactcccgaatccagccggggtctgagtttt

SEQ ID NO: 129205 - DNA, 2149 bp, Homo sapiens; identical to SEQ ID NO: 99231
  misc_feature 1..2149: note = chr8:24857402-24859551
  misc_feature 1..2149: note = Hyper
  source 1..2149: mol_type = genomic DNA

SEQ ID NO: 129206 - DNA, 398 bp, Homo sapiens; identical to SEQ ID NO: 99232
  misc_feature 1..398: note = chr8:25041548-25041946
  misc_feature 1..398: note = Hyper
  source 1..398: mol_type = genomic DNA

SEQ ID NO: 129207 - DNA, 36 bp, Homo sapiens; identical to SEQ ID NO: 99233
  misc_feature 1..36: note = chr8:25042248-25042284
  misc_feature 1..36: note = Hyper
  source 1..36: mol_type = genomic DNA

SEQ ID NO: 129208 - DNA, 96 bp, Homo sapiens; identical to SEQ ID NO: 99234
  misc_feature 1..96: note = chr8:25042737-25042833
  misc_feature 1..96: note = Hyper
  source 1..96: mol_type = genomic DNA

SEQ ID NO: 129209 - DNA, 41 bp, Homo sapiens; identical to SEQ ID NO: 41735
  misc_feature 1..41: note = chr8:25318815-25318856
  misc_feature 1..41: note = Hypo
  source 1..41: mol_type = genomic DNA

SEQ ID NO: 129210 - DNA, 216 bp, Homo sapiens; identical to SEQ ID NO: 41736
  misc_feature 1..216: note = chr8:25397045-25397261
  misc_feature 1..216: note = Hypo
  source 1..216: mol_type = genomic DNA

SEQ ID NO: 129211 - DNA, 138 bp, Homo sapiens; identical to SEQ ID NO: 99240
  misc_feature 1..138: note = chr8:25899282-25899420
  misc_feature 1..138: note = Hyper
  source 1..138: mol_type = genomic DNA

SEQ ID NO: 129212 - DNA, 1777 bp, Homo sapiens
  misc_feature 1..1777: note = chr8:25900408-25902185
  misc_feature 1..1777: note = Hyper
  source 1..1777: mol_type = genomic DNA
gggacagagacagggcggaatcctcgcgaccagccccggggatcgctggccaccacaaatgagatgaccgacatagggggccctccctcccagaggtgctaggtggggaaaagccaaactgttaaaaggcgagaacctcctttcctggggccaacgcgatccccactcatgctgcgttttctggcggcgccagccgaacccagtgactgtgaaacccaagttgggggacccggaaggcgccctcgagcgtgctgagtgtgtgcacacgcttcccagccaaccggtcgcagtcacagcccacctggccatcagatcccatttcaccgaagacttggggctgaggtgaacgcacagattgcgggagctgccctgcggcgctggggtctcccaggttgaaccccggtgcgcaagcaccttcattcactcttttgaaaggggtaacattttggctaagctctcccccactaagtctgctccttccagcttcaacaaactttttgatcccgggaaggaaggaaagcgagggaggcgtctttaaggagcccagctaaggaaatgcgcggcacagttggctctgcggtgctgccttatttcccttagctcgcaggcgggccagtcccgaagcgctgcggaaagccgcggccgccgcgctgtgcggtctgccggagggaaatccgcgctccccgggccacaggagggagggaaccgccgccggcccaagtcccggagcgataaaacttctgctttctccgctccaagggtagaggccggttcgctctacccgggacacctggccagtttgggaaagggatcatttctccgtgtgatgttggcacttaaatgtgggtggccaggagggcagcaggggaagcgagggtagtggaagaagttcatcggctctttgggggtagaagggctgcctctctcgcagacaaggacctggaggccacaaatcccaactcagtagtggtgatgagagagtgggaccgtaatgtcttcgtagggtggcaccccggacatggtatttactatcccagcacgcagacgcctaaacacaaagtcaacttcagggatccgcaaaaccagaggctggcgatccctgagccagtctagctgctggtggccttttctcgcctctttcttcttccgcaactctttctactgtgactcagtattttctcttcttttaaatctcttcttttctccagttccctagctccgttcgtctggctcactgttttatctttgagccgggaccctccagcctgtcccccctcccagagctcccggccgcctcgtcttcccgggcagccgctccggcttttcccgctcccctcgccgccgccaccctctggccgccggcctcccaggctccaggaatcgcccagcaagatgcgggaggtaggcgctcgcaggcggcgtggcgaagccaagagtggccaggaagccggctttcctcccgcgccgccactgccagcgccggtgttcacgctccgttcggggccaggccggctcggcttgcaggactaggggctgagctgggagatgttgggggctactttatttttccttgcaaagagtggactgtggtaaaggagagggagagaaacgcctacgacccaggcagttcaggaactcgagtgccggctgccgggtgagcgttcgcctgactgcagcgatctgcttgcccgagggcgagccccagcgcgcagggcctgggcgacagatggggggacagggagagagaaaggcacggggtgcgcggggggggtgcaca

SEQ ID NO: 129213 - DNA, 30 bp, Homo sapiens; identical to SEQ ID NO: 99244
  misc_feature 1..30: note = chr8:25902535-25902565
  misc_feature 1..30: note = Hyper
  source 1..30: mol_type = genomic DNA

SEQ ID NO: 129214 - DNA, 126 bp, Homo sapiens; identical to SEQ ID NO: 99245
  misc_feature 1..126: note = chr8:25902843-25902969
  misc_feature 1..126: note = Hyper
  source 1..126: mol_type = genomic DNA

SEQ ID NO: 129215 - DNA, 899 bp, Homo sapiens; identical to SEQ ID NO: 99246
  misc_feature 1..899: note = chr8:25903468-25904367
  misc_feature 1..899: note = Hyper
  source 1..899: mol_type = genomic DNA

SEQ ID NO: 129216 - DNA, 64 bp, Homo sapiens; identical to SEQ ID NO: 99247
  misc_feature 1..64: note = chr8:25904571-25904635
  misc_feature 1..64: note = Hyper
  source 1..64: mol_type = genomic DNA

SEQ ID NO: 129217 - DNA, 940 bp, Homo sapiens
  misc_feature 1..940: note = chr8:25904898-25905838
  misc_feature 1..940: note = Hyper
  source 1..940: mol_type = genomic DNA
agagtgtggaacagccgtgagcccttcaagacatgcctatgagcccggtgatttttttttcaagggggctttgatcagctgtacctccacgttgccccggaaaggtgcgcagggcacccggagaggcctctggtcagcagtgggcctgggccaagccccaacagtttacccctcaggctcaggttggctggggttaaagggcaaagtcagggtcgagggcaccagcttttctcggcggtaacagctgccacccaaattatgccccctcaggaagcgaatgaattgttcctttctcccagctccctgctgcccgccccaaaacagacggggccgcgctcggcgggcgcccctcctcccagccaaccccccgagacgcgctcaggggcctcggtgccccgctgggaggcaatttgggggagccgtggtcccgaactttgacagagtggggcttccccactacttgccggctgcgctaagggcgccccccgcggcagtgctgctgggagctccagggatggctgtgtggctcgctgcgggcgttgaagttccctgttggccaggctgaagtgcctgcgcgagcgtgaggggacaaggactgccttgggcccagcgtggcggcgtttcggccaacccagttggggttaattgcgtctgtataggttttgggtaggaatgctcgcggagtccgccacccgcgcgaaacatgcgttggttgggggaatgagcagcggcggctgcgcctggagggttgctcccacctctgtcgcctccagctacccccaaacaaacctccttttcgatctcgtgcaacacaaaacctgccccgagctgtgcgggggcctggcaagcgcagctgcggccccgggaagcccaatcccgcgggactgcggagcccacgcgctcctcaggctccggccaactagctcggttctgcctctag

SEQ ID NO: 129218 - DNA, 120 bp, Homo sapiens
  misc_feature 1..120: note = chr8:25906048-25906168
  misc_feature 1..120: note = Hyper
  source 1..120: mol_type = genomic DNA
ttgctcaatctcgtccggtccagtcatctgggcgccaagtctctcctcccgatcagaggttcggaaattttacttagaaactgctctcctggctgtgttcctgtccggcaggacactggg

SEQ ID NO: 129219 - DNA, 43 bp, Homo sapiens
  misc_feature 1..43: note = chr8:25906974-25907017
  misc_feature 1..43: note = Hyper
  source 1..43: mol_type = genomic DNA
cgggtgcagaacgagcgaggaagcaaagcggaaaggtcaagag

SEQ ID NO: 129220 - DNA, 57 bp, Homo sapiens; identical to SEQ ID NO: 31863
  misc_feature 1..57: note = chr8:25907271-25907328
  misc_feature 1..57: note = Hyper
  source 1..57: mol_type = genomic DNA

SEQ ID NO: 129221 - DNA, 103 bp, Homo sapiens
  misc_feature 1..103: note = chr8:25907858-25907961
  misc_feature 1..103: note = Hyper
  source 1..103: mol_type = genomic DNA
gcacaagcgctcactcggccccgcacgcaagcagcgccccgcgcgcccggggccctcctcggataagggaggggtgacaaaagtctcccgctcactgctgcct

SEQ ID NO: 129222 - DNA, 125 bp, Homo sapiens
  misc_feature 1..125: note = chr8:25908392-25908517
  misc_feature 1..125: note = Hyper
  source 1..125: mol_type = genomic DNA
ccccctcacctgccgcgagccgggcaatcatttcggggcgccagtgggtccagggcgcacgggacatggcacccacggaaaacctcagagccagctgggaaaacagagatcgctctcctggccgg

SEQ ID NO: 129223 - DNA, 737 bp, Homo sapiens
  misc_feature 1..737: note = chr8:25908962-25909699
  misc_feature 1..737: note = Hyper
  source 1..737: mol_type = genomic DNA
gctttgcttgccttacggataagacagcttaggtgaaagtatctggcacgcagtaggtgttcaataaacgcttgctttccttcagcatctgcaggtgtaagatgaggatgatcacatctgcttatggaattcactgggtcctgagtctcctatggggatgggtttcctttcccccgacctatgcgctcctgaggcagggattctgactcgcttgtccttgcagctcctttgcctggcacagggactggatcgctcagtgggtgataagctttttgtttgttccgcatggaattgcatgtgagaaaagcgctttggaagctgtttggtgcacgcgggcgtcagagggcaccgtaggtcactgagcggggtctcacccagggagagaatgcgacttcattcctaggaggctgtgctgggggctccgcgctgcgcgcggcagtgagtagggcgcaccccgaatgcaagtgcggttcgctgcgtggccgcgtgctgggatggatcgcggaactcgctagataattgaagatctcgaggagctctgaaatggatcttcggtttctacgacaaacccccgtcgatgagtggttcacagagagcttggggagcccctccccgccctgcgccctcaggaagagacgcggctcgcctgacactactggtctctgtctcccgagagccagagccgagctccccgagtggtgctttccagagcccgcattaaacgaagctgggaggga

SEQ ID NO: 129224 - DNA, 30 bp, Homo sapiens; identical to SEQ ID NO: 99256
  misc_feature 1..30: note = chr8:26187766-26187796
  misc_feature 1..30: note = Hypo
  source 1..30: mol_type = genomic DNA

SEQ ID NO: 129225 - DNA, 124 bp, Homo sapiens; identical to SEQ ID NO: 99257
  misc_feature 1..124: note = chr8:26267081-26267205
  misc_feature 1..124: note = Hypo
  source 1..124: mol_type = genomic DNA

SEQ ID NO: 129226 - DNA, 30 bp, Homo sapiens; identical to SEQ ID NO: 99258
  misc_feature 1..30: note = chr8:26267880-26267910
  misc_feature 1..30: note = Hypo
  source 1..30: mol_type = genomic DNA

SEQ ID NO: 129227 - DNA, 200 bp, Homo sapiens; identical to SEQ ID NO: 99259
  misc_feature 1..200: note = chr8:26306037-26306237
  misc_feature 1..200: note = Hyper
  source 1..200: mol_type = genomic DNA

SEQ ID NO: 129228 - DNA, 38 bp, Homo sapiens; identical to SEQ ID NO: 99260
  misc_feature 1..38: note = chr8:26370063-26370101
  misc_feature 1..38: note = Hyper
  source 1..38: mol_type = genomic DNA

SEQ ID NO: 129229 - DNA, 663 bp, Homo sapiens
  misc_feature 1..663: note = chr8:26370549-26371212
  misc_feature 1..663: note = Hyper
  source 1..663: mol_type = genomic DNA
ggcgggggaaccaggcggggctctggggcgcaggggaaagctggagatttgggaagggggtttcagtttgttttttctctctttttttttttttttttttttttttggtggaggaagcagaataaaccaaatcgcgacacgttcctgcgcccttcttggcgcagtggcgcagacacggtccatggcgccttgcgcaatagagtcggtctgcaccccgtctttaagtcgtggccctgggctggaattcccgactgcactctttgctacacccccatagaccgcagacctgcgtctctctctatattcctctcccatctgctacgcccctctgaatttcttcccgccatgttgtgtgccccccccccactcccccgtcaccccaaccacaccaaagtggatgcacgaagcgggaaccttctcgtttcagtctctgctccctgcagcctgccaaggcgagtggacaaactgaagctggggtgtccagcgtcttggctgcccccctcctgtccaccctgcctgtgctatccttgctcatcttcagtgccatcccgcttcccacaccctgagtagcctggcgcccggcttgtccccttttcccatccatcagctcacacccagggtaacggggcgggacccctatccacagtgcgccctcgcccccgg

SEQ ID NO: 129230 - DNA, 480 bp, Homo sapiens; identical to SEQ ID NO: 99263
  misc_feature 1..480: note = chr8:26371670-26372150
  misc_feature 1..480: note = Hyper
  source 1..480: mol_type = genomic DNA

SEQ ID NO: 129231 - DNA, 500 bp, Homo sapiens; identical to SEQ ID NO: 99264
  misc_feature 1..500: note = chr8:26372420-26372920
  misc_feature 1..500: note = Hyper
  source 1..500: mol_type = genomic DNA

SEQ ID NO: 129232 - DNA, 135 bp, Homo sapiens; identical to SEQ ID NO: 99266
  misc_feature 1..135: note = chr8:26629344-26629479
  misc_feature 1..135: note = Hypo
  source 1..135: mol_type = genomic DNA

SEQ ID NO: 129233 - DNA, 159 bp, Homo sapiens; identical to SEQ ID NO: 99267
  misc_feature 1..159: note = chr8:26637232-26637391
  misc_feature 1..159: note = Hypo
  source 1..159: mol_type = genomic DNA

SEQ ID NO: 129234 - DNA, 64 bp, Homo sapiens; identical to SEQ ID NO: 99268
  misc_feature 1..64: note = chr8:26721627-26721691
  misc_feature 1..64: note = Hyper
  source 1..64: mol_type = genomic DNA

SEQ ID NO: 129235 - DNA, 30 bp, Homo sapiens; identical to SEQ ID NO: 99269
  misc_feature 1..30: note = chr8:26722735-26722765
  misc_feature 1..30: note = Hyper
  source 1..30: mol_type = genomic DNA

SEQ ID NO: 129236 - DNA, 1667 bp, Homo sapiens
  misc_feature 1..1667: note = chr8:26722986-26724653
  misc_feature 1..1667: note = Hyper
  source 1..1667: mol_type = genomic DNA
ccgatggttgggtagcgcagcgctacaggttgggcgctgctcctggcccgcagttacctacattttgagctgccccaccgaaggctcctgctctctccagcttctaggagcacaggtcaggggacgtaggtgtggaatatgtgctgagacccaggaggctgcggggcatcgtttgaccgcgtccacctgaaagagcgcaaagagaaaggcggctttgagctaggcgccccagggaaagaggctgtgctgagcttgacgggttgggggacaccagttgggagccgggttggttctgcggtccagaagctgcttcgcccggcagcggtggaggcgacttcggagctcatctcgcgcccccaccactgggaacctgcctagcgcactctactgagtcacctctgcccgagttcaggatccgaagcgaaaaacaaacaaaaaaacaaatccccaaaaccccaggctccagcgctcgaagtctggatttcgagcgcaggtaccacgaaattaaaatcctcgaagccccggaggggcgactgcggctggcgagtgtgtcgcacggatcctagccggggaattctggaggatgtactcggtttccgttagaacaggttgcctcgcagtcacctggagggggcggcctgggagagggaacagctgcgacccagggacctcagggccaggaccacgagcacgctcactctcacgccggtggaattcgcactcgggtgtgcagagcgcaccggtctgtccaccagccaagctggcttgagagccaggtcccgagcgaagccgggagggacccgaagacagaaagcgacccaggtctgtccacgacgcctttccaagcctcactgttggccacccgaggggctccagctgccagccgtagcgggactggcgggggacggggtggggaggacgtccctctgcagagggagctttgcaagtgacagtcactgcggattttgcaggcgtaaacattaagccggcatgccagcgggcaggggccgccttcgattttctgggctgggggccaccatctgcgtaagaaacctgggtttccacaactgcgaacctaccgcagggactcggcaggacagcgcggcgtgaggaagtgcccaccttgccttctggggttgggccctgaggtgggacctcgggcaaagactcttgttaaaatcgcaagttggagacctcacaggtggtattaaaaacgtgccactgcagaaacccttttcctcctacctcgagggtgataaacacagggttaaaaagacacttgttcagtagaaggcaacttcgcagaagatgtaagggaatcgggggtggggtagaggggccggtataaaacctggtggaaaaagcgggaggcgctgggaaaagtgggggttccgtctcaccagacggcgggggaggtctgccctcacccactcggccctgcgggacgccggccccggcgcactcacctgaagcgccgctgctgagccaccagctcgcgcgcgggggatgtggacccggcttcggtcccgggagctgcctgcctgctcttctctggaggcggagaggggaccgtgtctccgaggcaccaaatccttgtccttttgcacccgctgactcacccctccaccactgatgtctttaagctcctgaaccgctgtcactttacc

SEQ ID NO: 129237 - DNA, 150 bp, Homo sapiens; identical to SEQ ID NO: 99273
  misc_feature 1..150: note = chr8:26852267-26852417
  misc_feature 1..150: note = Hypo
  source 1..150: mol_type = genomic DNA

SEQ ID NO: 129238 - DNA, 30 bp, Homo sapiens; identical to SEQ ID NO: 99275
  misc_feature 1..30: note = chr8:27320956-27320986
  misc_feature 1..30: note = Hypo
  source 1..30: mol_type = genomic DNA

SEQ ID NO: 129239 - DNA, 30 bp, Homo sapiens; identical to SEQ ID NO: 99276
  misc_feature 1..30: note = chr8:27449851-27449881
  misc_feature 1..30: note = Hyper
  source 1..30: mol_type = genomic DNA

SEQ ID NO: 129240 - DNA, 39 bp, Homo sapiens; identical to SEQ ID NO: 99277
  misc_feature 1..39: note = chr8:27472031-27472070
  misc_feature 1..39: note = Hyper
  source 1..39: mol_type = genomic DNA

SEQ ID NO: 129241 - DNA, 440 bp, Homo sapiens; identical to SEQ ID NO: 99278
  misc_feature 1..440: note = chr8:27491124-27491564
  misc_feature 1..440: note = Hyper
  source 1..440: mol_type = genomic DNA

SEQ ID NO: 129242 - DNA, 30 bp, Homo sapiens; identical to SEQ ID NO: 99279
  misc_feature 1..30: note = chr8:27779779-27779809
  misc_feature 1..30: note = Hypo
  source 1..30: mol_type = genomic DNA

SEQ ID NO: 129243 - DNA, 100 bp, Homo sapiens; identical to SEQ ID NO: 99280
  misc_feature 1..100: note = chr8:27914736-27914836
  misc_feature 1..100: note = Hypo
  source 1..100: mol_type = genomic DNA

SEQ ID NO: 129244 - DNA, 30 bp, Homo sapiens; identical to SEQ ID NO: 41739
  misc_feature 1..30: note = chr8:27931084-27931114
  misc_feature 1..30: note = Hypo
  source 1..30: mol_type = genomic DNA

SEQ ID NO: 129245 - DNA, 234 bp, Homo sapiens; identical to SEQ ID NO: 99282
  misc_feature 1..234: note = chr8:28209327-28209561
  misc_feature 1..234: note = Hypo
  source 1..234: mol_type = genomic DNA

SEQ ID NO: 129246 - DNA, 121 bp, Homo sapiens; identical to SEQ ID NO: 99283
  misc_feature 1..121: note = chr8:28221168-28221289
  misc_feature 1..121: note = Hyper
  source 1..121: mol_type = genomic DNA

SEQ ID NO: 129247 - DNA, 34 bp, Homo sapiens; identical to SEQ ID NO: 99284
  misc_feature 1..34: note = chr8:28515693-28515727
  misc_feature 1..34: note = Hyper
  source 1..34: mol_type = genomic DNA

SEQ ID NO: 129248 - DNA, 30 bp, Homo sapiens; identical to SEQ ID NO: 99285
  misc_feature 1..30: note = chr8:28926240-28926270
  misc_feature 1..30: note = Hypo
  source 1..30: mol_type = genomic DNA

SEQ ID NO: 129249 - DNA, 30 bp, Homo sapiens; identical to SEQ ID NO: 41740
  misc_feature 1..30: note = chr8:28938557-28938587
  misc_feature 1..30: note = Hypo
  source 1..30: mol_type = genomic DNA

SEQ ID NO: 129250 - DNA, 30 bp, Homo sapiens; identical to SEQ ID NO: 41741
  misc_feature 1..30: note = chr8:29157762-29157792
  misc_feature 1..30: note = Hypo
  source 1..30: mol_type = genomic DNA

SEQ ID NO: 129251 - DNA, 218 bp, Homo sapiens; identical to SEQ ID NO: 99288
  misc_feature 1..218: note = chr8:29209258-29209476
  misc_feature 1..218: note = Hyper
  source 1..218: mol_type = genomic DNA

SEQ ID NO: 129252 - DNA, 140 bp, Homo sapiens; identical to SEQ ID NO: 99289
  misc_feature 1..140: note = chr8:29209803-29209943
  misc_feature 1..140: note = Hyper
  source 1..140: mol_type = genomic DNA

SEQ ID NO: 129253 - DNA, 35 bp, Homo sapiens; identical to SEQ ID NO: 99290
  misc_feature 1..35: note = chr8:29387332-29387367
  misc_feature 1..35: note = Hyper
  source 1..35: mol_type = genomic DNA

SEQ ID NO: 129254 - DNA, 77 bp, Homo sapiens; identical to SEQ ID NO: 99291
  misc_feature 1..77: note = chr8:29387636-29387713
  misc_feature 1..77: note = Hyper
  source 1..77: mol_type = genomic DNA

SEQ ID NO: 129255 - DNA, 28 bp, Homo sapiens
  misc_feature 1..28: note = chr8:29596408-29596436
  misc_feature 1..28: note = Hypo
  source 1..28: mol_type = genomic DNA
tttttaggctgggcacggtagttcatgc

SEQ ID NO: 129256 - DNA, 28 bp, Homo sapiens
  misc_feature 1..28: note = chr8:29596676-29596704
  misc_feature 1..28: note = Hypo
  source 1..28: mol_type = genomic DNA
cagaacaagactccgtctcaaaaaaaaa

SEQ ID NO: 129257 - DNA, 29 bp, Homo sapiens
  misc_feature 1..29: note = chr8:30241265-30241294
  misc_feature 1..29: note = Hyper
  source 1..29: mol_type = genomic DNA
tataccccttagcccgtttaaatagccgt

SEQ ID NO: 129258 - DNA, 111 bp, Homo sapiens; identical to SEQ ID NO: 99295
  misc_feature 1..111: note = chr8:30241501-30241612
  misc_feature 1..111: note = Hyper
  source 1..111: mol_type = genomic DNA

SEQ ID NO: 129259 - DNA, 67 bp, Homo sapiens; identical to SEQ ID NO: 99296
  misc_feature 1..67: note = chr8:30242630-30242697
  misc_feature 1..67: note = Hyper
  source 1..67: mol_type = genomic DNA

SEQ ID NO: 129260 - DNA, 117 bp, Homo sapiens; identical to SEQ ID NO: 99297
  misc_feature 1..117: note = chr8:30243058-30243175
  misc_feature 1..117: note = Hyper
  source 1..117: mol_type = genomic DNA

SEQ ID NO: 129261 - DNA, 159 bp, Homo sapiens; identical to SEQ ID NO: 99298
  misc_feature 1..159: note = chr8:30243388-30243547
  misc_feature 1..159: note = Hyper
  source 1..159: mol_type = genomic DNA

SEQ ID NO: 129262 - DNA, 1020 bp, Homo sapiens
  misc_feature 1..1020: note = chr8:30769168-30770188
  misc_feature 1..1020: note = Hyper
  source 1..1020: mol_type = genomic DNA
aaacttgaagggaaccgtggtatcttcaaagtctccgagttgccagcgacctcagcctctccactttctcgaacatcatccctgggcactgtctcccgacacagccagcgcggtggccatgcgcctcaaaccgagcattccaaacgcggaaactcaaccccgagcgcggagaggatggaaactgcctgaaaggatctgtgcagggctgggcttgggacgcggctcacacgaaactgaggcaggagtctcttcctgcacccgcaccacgccgggacccgaggggtttcactcccttcactgagccgagccaggaagccaagagccaccagggcgaagcagccctgcaaaacctccactcagccttacaacagccacagcgccgggacacgcggcaccgcatcccgggcgcgccagtcctcctgcagtcgggggacgctcccctcaggcgcccgcgtcggagcccagctacccccgcgccgccctcacctaccgaggctcccccgcgtccaccggctcctgcagcgagacagccggcgcaggcgggcatggtccgagcgcgggctctgcaggggagaatgaggcgcgcggactgccagtcacccgggcggcgttccccgccctagcgctccagggtcgcgagtcccacaggagtcccgagttgcggtcccggggcggcggggctcccgccccctccccgcccccgcggatatccccacgcaccacgaagatccccacgcgccctgcgcaacgcggctgctccgcgctgccttctgctgactacaaactgcgcctccagggagccagggcgaggcggaggccaccaccaagttgtggcgctctctcctctcgctgcctcagagcagcgagtttctcctcagctgcaaacaaggacgcagggccagctccgtggggctcagcgggggcagagggagagcgaaagcgcgggaacccgcgcatctgaggaaagctaaacatttcacctgtagagtcggctgccctggccctcggaggcccaccttt

SEQ ID NO: 129263 - DNA, 435 bp, Homo sapiens; identical to SEQ ID NO: 99305
  misc_feature 1..435: note = chr8:30890092-30890527
  misc_feature 1..435: note = Hyper
  source 1..435: mol_type = genomic DNA

SEQ ID NO: 129264 - DNA, 645 bp, Homo sapiens
  misc_feature 1..645: note = chr8:31496433-31497078
  misc_feature 1..645: note = Hyper
  source 1..645: mol_type = genomic DNA
cagtaaaagaaaaggcgggggtcatgaagaccgaaggatcaaaggagcatggagtagaggaggcgtcacatctgaagtgcacactgtgtgtgcgcgctgcaaggagagagagcgttataaagttgttgttttaatcgctgcttgtcgcctgcgaacatgttgctcccttttaagtgtcaagcaacgggttcacccaaaacttttctgcaccgaggacccgcacgcccggggtcccacctgcccctctctgcctgcctcccaccggcgcctgggcatcctgcgccggctacaggtccttgctcactgaagcgtcacctctcactccccagtaagcctccgcagcccactcggactgcagcctgtttgccgcccgtcctcccattgcagcactcggggcgacagagagggaggaggcgcgcggggacggggacgcccaggaggacccactcgcgggtcccgctccgctccggcagcagcatggggaaaggacgcgcgggccgagttggcaccacaggtaaacaggctggcgaggcgcaggacgctgtcgccgccgcggccacccagcgatttccaggcacgcaactccgcctccagggctctctccctcgcgctctctcccagccgcttgctcgcagccccagcagc

SEQ ID NO: 129265 - DNA, 907 bp, Homo sapiens
  misc_feature 1..907: note = chr8:31497426-31498333
  misc_feature 1..907: note = Hyper
  source 1..907: mol_type = genomic DNA
ggaaaagggaggcagcgcgagagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcggtaagttcctcgcccttgggggcgcgaacccgcggcgaggagggcgcatcccgggcgcgcgggcagcggggctcgacggccgcccgag

SEQ ID NO: 129266 - DNA, 30 bp, Homo sapiens; identical to SEQ ID NO: 99310
  misc_feature 1..30: note = chr8:31728987-31729017
  misc_feature 1..30: note = Hypo
  source 1..30: mol_type = genomic DNA

SEQ ID NO: 129267 - DNA, 208 bp, Homo sapiens; identical to SEQ ID NO: 99311
  misc_feature 1..208: note = chr8:32277303-32277511
  misc_feature 1..208: note = Hypo
  source 1..208: mol_type = genomic DNA

SEQ ID NO: 129268 - DNA, 158 bp, Homo sapiens; identical to SEQ ID NO: 31883
  misc_feature 1..158: note = chr8:32404798-32404956
  misc_feature 1..158: note = Hyper
  source 1..158: mol_type = genomic DNA

SEQ ID NO: 129269 - DNA, 1529 bp, Homo sapiens
  misc_feature 1..1529: note = chr8:32405453-32406982
  misc_feature 1..1529: note = Hyper
  source 1..1529: mol_type = genomic DNA
agcagccctcccaggcgctgcctggctgcggaggggagcgggcagcgagagcctcgggtctccgcctgggttcccgggtctccggggcgctggcctcggtctccgcgcagcgtccagcgacccctgtcgggggttcccggcagccgcgccgccaccccccgcccggccagcgcgggaggaaaaggggctgcgcccgggagcgccgagcccaggctcctcccggtggcgtgtccgcgcctcggggtgggggtgtggtggggaagagggagggggcgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaat

SEQ ID NO: 129270 - DNA, 148 bp, Homo sapiens; identical to SEQ ID NO: 41744
  misc_feature 1..148: note = chr8:32987430-32987578
  misc_feature 1..148: note = Hypo
  source 1..148: mol_type = genomic DNA

SEQ ID NO: 129271 - DNA, 439 bp, Homo sapiens; identical to SEQ ID NO: 99319
  misc_feature 1..439: note = chr8:33371767-33372206
  misc_feature 1..439: note = Hyper
  source 1..439: mol_type = genomic DNA

SEQ ID NO: 129272 - DNA, 450 bp, Homo sapiens; identical to SEQ ID NO: 99320
  misc_feature 1..450: note = chr8:33456975-33457425
  misc_feature 1..450: note = Hyper
  source 1..450: mol_type = genomic DNA

SEQ ID NO: 129273 - DNA, 30 bp, Homo sapiens; identical to SEQ ID NO: 99321
  misc_feature 1..30: note = chr8:33578771-33578801
  misc_feature 1..30: note = Hypo
  source 1..30: mol_type = genomic DNA

SEQ ID NO: 129274 - DNA, 89 bp, Homo sapiens; identical to SEQ ID NO: 99322
  misc_feature 1..89: note = chr8:35092605-35092694
  misc_feature 1..89: note = Hyper
  source 1..89: mol_type = genomic DNA

SEQ ID NO: 129275 - DNA, 619 bp, Homo sapiens
  misc_feature 1..619: note = chr8:35092985-35093604
  misc_feature 1..619: note = Hyper
  source 1..619: mol_type = genomic DNA
ctccgctccgtagttcggggcccggcagcggcgcgagggctgggaactgcgcggcggggactgcgggcgactccggcatccgcgctggcggcagcggtcgccgcgccgtgggaagctatggggacgcgccctttctcggggtgcccattcagcggcggctcggagctccctgccccgctgctttaggaagcgatcgtggagcagagtcactctctgaagactcccgagacccattcgactcgggaccctcatcgccgaccctttcccgggctcccggagcgtgaagaagagccgccctccggaacgcggcgaggagcatggggagagcggcggccaccgcaggcggcggcggaggggcgcgccgctggctcccgtggctggggctgtgcttctgggcggcagggaccgcggctgcccgaggtaagcgctgggcggagcgggcagctgggggcgagggcgcaggggcgccagcctgacggagcgggacctgcaccgatggcgttggcttcccaacttgcgccctgcacctcggcgctccaagcccaaccggatgggagccgagtggaggactccgaggggaccacagccttccaacccaagtttgcgatctgccgcaatc

SEQ ID NO: 129276 - DNA, 116 bp, Homo sapiens
  misc_feature 1..116: note = chr8:35093951-35094067
  misc_feature 1..116: note = Hyper
  source 1..116: mol_type = genomic DNA
gccagccctggagctcgggagagcggcgtgcaccatcccagtttaaccgcgcctgcagtgcccagccgggatgagcacttggcccgaggctgctcaccaggcgcctcctctccctt

SEQ ID NO: 129277 - DNA, 26 bp, Homo sapiens
  misc_feature 1..26: note = chr8:36179048-36179074
  misc_feature 1..26: note = Hypo
  source 1..26: mol_type = genomic DNA
ggccgagacctgcagcggaacctagg

SEQ ID NO: 129278 - DNA, 204 bp, Homo sapiens; identical to SEQ ID NO: 99329
  misc_feature 1..204: note = chr8:36852809-36853013
  misc_feature 1..204: note = Hypo
  source 1..204: mol_type = genomic DNA

SEQ ID NO: 129279 - DNA, 34 bp, Homo sapiens; identical to SEQ ID NO: 99330
  misc_feature 1..34: note = chr8:37552075-37552109
  misc_feature 1..34: note = Hyper
  source 1..34: mol_type = genomic DNA

SEQ ID NO: 129280 - DNA, 494 bp, Homo sapiens; identical to SEQ ID NO: 99331
  misc_feature 1..494: note = chr8:37552317-37552811
  misc_feature 1..494: note = Hyper
  source 1..494: mol_type = genomic DNA

SEQ ID NO: 129281 - DNA, 30 bp, Homo sapiens; identical to SEQ ID NO: 99332
  misc_feature 1..30: note = chr8:37595317-37595347
  misc_feature 1..30: note = Hyper
  source 1..30: mol_type = genomic DNA

SEQ ID NO: 129282 - DNA, 901 bp, Homo sapiens
  misc_feature 1..901: note = chr8:37655313-37656214
  misc_feature 1..901: note = Hyper
  source 1..901: mol_type = genomic DNA
gtgaagtggagagcacgcctgcagggcacccacgccccggatttccagcctggactagggttgcggactttggggacctgagaagggtgagagcggggaatgctcaggaaagatcgacgctcgtggcccaggagggggctgtggtcctaaccactacggtcgcgtcccggactgggctggaggagtctccggatttacctggctggccttgtcccttcaattggggtcatcccatccttgccccctggcctgccagcgccgcttccagccggtctccttagggcaaggggaggctgggctcagaaaagtcggcccttggaataccggcgctcctgggctgcaggagaccctggcgtccccatccctctagaggcccctctcccacggcgccgtttgtgcagtgagctctgtgctgggtcccgcgtccttgcctctcctttgcctctcctggaagtaactcgagctttggctgtttctccattgacttcgcgcaaagattgcgaagaaagaaacgcggctggggaagcggggttccctcaccgcagcccacccgggcctccttccgcgacttccctcttagtcagggcctcagtacgcctttgctttgctggcagcgagcgctgcagcgccgcagcccgaccccaagcctcctacaagggggtcgcaagtcccagcagccgcgcgagcattggcgacccctccccaccgcagagatttcctgcgccgaccacgtgctcgcagctccacgcacgccgtggatttgagggtcgggcccccgcggccgccgcttcctttcctgtcccaaatccagcctaagagccgcttccctttccctgtcctcctgaccccagtggcaaccgtttctccaccgccccttgcccgcagtcggggctggcccagt

SEQ ID NO: 129283 - DNA, 47 bp, Homo sapiens; identical to SEQ ID NO: 99337
  misc_feature 1..47: note = chr8:37706125-37706172
  misc_feature 1..47: note = Hypo
  source 1..47: mol_type = genomic DNA

SEQ ID NO: 129284 - DNA, 30 bp, Homo sapiens; identical to SEQ ID NO: 99338
  misc_feature 1..30: note = chr8:37708497-37708527
  misc_feature 1..30: note = Hypo
  source 1..30: mol_type = genomic DNA

SEQ ID NO: 129285 - DNA, 30 bp, Homo sapiens; identical to SEQ ID NO: 99339
  misc_feature 1..30: note = chr8:37721639-37721669
  misc_feature 1..30: note = Hypo
  source 1..30: mol_type = genomic DNA

SEQ ID NO: 129286 - DNA, 59 bp, Homo sapiens; identical to SEQ ID NO: 99340
  misc_feature 1..59: note = chr8:37762770-37762829
  misc_feature 1..59: note = Hypo
  source 1..59: mol_type = genomic DNA

SEQ ID NO: 129287 - DNA, 1097 bp, Homo sapiens
  misc_feature 1..1097: note = chr8:37822626-37823723
  misc_feature 1..1097: note = Hyper
  source 1..1097: mol_type = genomic DNA
ggtcccattttggttcgctactcctcgttcccttttctctccaagcaaagccatcccaccttctcttaataaactccacactcaaaaagttgacccacggacacatcgcatgcttcccgaccctgagccgccggtccctctgccccggttacctacccgtcgagccgttggcaaagcctgggctgcgctgggctgctccgggccgcaggaacgcccgaggggaagagggccgggcgggcggcggcgcagggctccggaggcaggcgacggccgcagcggcacagaagacggcggaaggcgctgcgaaagtccgggctgcggcagtagatgagcgggttgaaggcagaattggcataacctagccagttcagggcaaggaaagccgggcccgggactagagaggggccccccagggcgcgcagcacgttggccagaaagaagggcaaccagcagagagtgaaggtgcccatgatgagacccaaggtgcacagggcccggtgttcccggagaggcaggaggcgcgcgggccgccggccgcaggcgggcaccccttcgggcggagcgcacgtccccaccggggccggggccagagagcgcgacggcgccggcggagactcctcgggcggaaagcggcccagctccccgcgcagcaagcgcagctggcgcgtagccaccacgaaaacccgcgcgtagacgaagagcatcacgagaagaggaaggtagaaggagacggaggaggacagcagcacgtagggcatgttggaggcgaaggcacagcagcgcgggttggagtggcagcgctgcgcctcggcgtcggcccctacgcgccaccactggctcatgatgggcgcaaacgacaccgcggccgacacgacccacaccaggaccacagctgtccgggcgcagcgcttggtgaccagtgcgccgtaacgcagcgggttggtcacagccaggtagcggtccacggccagggcgcacagggtttcgatgctggcggtcacacacagcacgtccaccgaggtccacagctcgcagccagtggcgcccaacggccagtggccagtcagcgccaaggtggccgccggcggcaccaccag

SEQ ID NO: 129288 - DNA, 30 bp, Homo sapiens; identical to SEQ ID NO: 99344
  misc_feature 1..30: note = chr8:37891941-37891971
  misc_feature 1..30: note = Hypo
  source 1..30: mol_type = genomic DNA

SEQ ID NO: 129289 - DNA, 30 bp, Homo sapiens; identical to SEQ ID NO: 99345
  misc_feature 1..30: note = chr8:37935813-37935843
  misc_feature 1..30: note = Hypo
  source 1..30: mol_type = genomic DNA

SEQ ID NO: 129290 - DNA, 99 bp, Homo sapiens; identical to SEQ ID NO: 99346
  misc_feature 1..99: note = chr8:37961833-37961932
  misc_feature 1..99: note = Hypo
  source 1..99: mol_type = genomic DNA

SEQ ID NO: 129291 - DNA, 30 bp, Homo sapiens; identical to SEQ ID NO: 41747
  misc_feature 1..30: note = chr8:38005823-38005853
  misc_feature 1..30: note = Hypo
  source 1..30: mol_type = genomic DNA

SEQ ID NO: 129292 - DNA, 415 bp, Homo sapiens; identical to SEQ ID NO: 99348
  misc_feature 1..415: note = chr8:38008209-38008624
  misc_feature 1..415: note = Hyper
  source 1..415: mol_type = genomic DNA

SEQ ID NO: 129293 - DNA, 30 bp, Homo sapiens; identical to SEQ ID NO: 99349
  misc_feature 1..30: note = chr8:38257005-38257035
  misc_feature 1..30: note = Hypo
  source 1..30: mol_type = genomic DNA

SEQ ID NO: 129294 - DNA, 1139 bp, Homo sapiens
  misc_feature 1..1139: note = chr8:38323156-38324295
  misc_feature 1..1139: note = Hyper
  source 1..1139: mol_type = genomic DNA
gaggctgctgaacctcggtcaccgagaggaaggtggatgacccgggcgtgggggtgattacccagaccaaggcgcgtcccacggggccctgctacttcgcttttaaacaagcctcagggaggaaaccgggagcccgggccaagggaggaaaatggccactttctgctaaacagtctcaaggctagatagtattccaaaaaaagcgctggtccggaggtgcaaagggtagggcacatctgcggaggaaacagtcaccttaattaccacgtctagagaaagtgcgatttcattacagcctccaaaactaccgcccaaagaaggaaaccagagaagtgttttcaatttgaaagaggctggaaagaagcgggtaagacaccgactctccccaccctcccggcaactttggaccacaaggcgctttcctgcctcaaagactattaccaaacacaactcgaaaatccaaccccgctttcaaacctgtagccgttatttaaacggtaaaacaccccactttagtttccgggggatgcggcccaaatcagtccttaaaaacacacagagagcgcctctggcagcagccgcccacgcccccggccctgcgcaccgggcttgctccgggaggggcgcgtgacgccaccgcggggcagccgagaggggaccgcgggctccgggcagggcaggcgctcccgcagctccagctataacacaagggagagaaagcaacgctttggttccagaaacttccatcgtcaaggccagttctggccagacgcacagccaaagagcccccctagtctagcggatgaaccgttcgcgagtggcaccccctaaaaccttggccccatctcccaagatgcctctttactgcgcaatccagaaagcacccggaccgccgccacccaccagcggcggcgaataacttggtgagatcttaaataactcgggatccaagggaactttcttttctcccccgaatctcaacgccgcatctccaagtctccagaaatgttaaggagggaggtggtcaagacaggctgaagaatctgagttttaatttgggggagggggaggggaggaagagggaagttaataatgcggctgcggtgtacccgtgtggggtgaaacggaaccagatgcgg

SEQ ID NO: 129295 - DNA, 200 bp, Homo sapiens
  misc_feature 1..200: note = chr8:38324661-38324861
  misc_feature 1..200: note = Hyper
  source 1..200: mol_type = genomic DNA
gaaccagattgggaccgaacggtccttccgcccccatcccacacctcggcttaacgaccgtgggttgtcctcccgttccccaaacttccgaccctttcagagaccgtccaagtcataagatcaccccttctggaaaggggagtcgtttttcgctctcagctcaagcagattcagccatttggtgacgacacctccttaaa

SEQ ID NO: 129296 - DNA, 974 bp, Homo sapiens; identical to SEQ ID NO: 99354
  misc_feature 1..974: note = chr8:38325076-38326050
  misc_feature 1..974: note = Hyper
  source 1..974: mol_type = genomic DNA

SEQ ID NO: 129297 - DNA, 218 bp, Homo sapiens; identical to SEQ ID NO: 99355
  misc_feature 1..218: note = chr8:38326276-38326494
  misc_feature 1..218: note = Hyper
  source 1..218: mol_type = genomic DNA

SEQ ID NO: 129298 - DNA, 76 bp, Homo sapiens; identical to SEQ ID NO: 99356
  misc_feature 1..76: note = chr8:38400221-38400297
  misc_feature 1..76: note = Hypo
  source 1..76: mol_type = genomic DNA

SEQ ID NO: 129299 - DNA, 94 bp, Homo sapiens; identical to SEQ ID NO: 99357
  misc_feature 1..94: note = chr8:38614414-38614508
  misc_feature 1..94: note = Hyper
  source 1..94: mol_type = genomic DNA

SEQ ID NO: 129300 - DNA, 272 bp, Homo sapiens; identical to SEQ ID NO: 99358
  misc_feature 1..272: note = chr8:38614788-38615060
  misc_feature 1..272: note = Hyper
  source 1..272: mol_type = genomic DNA

SEQ ID NO: 129301 - DNA, 31 bp, Homo sapiens; identical to SEQ ID NO: 41748
  misc_feature 1..31: note = chr8:38786050-38786081
  misc_feature 1..31: note = Hypo
  source 1..31: mol_type = genomic DNA

SEQ ID NO: 129302 - DNA, 23 bp, Homo sapiens
  misc_feature 1..23: note = chr8:38857793-38857816
  misc_feature 1..23: note = Hypo
  source 1..23: mol_type = genomic DNA
agccaccgcgccccagcctctct

SEQ ID NO: 129303 - DNA, 30 bp, Homo sapiens; identical to SEQ ID NO: 99361
  misc_feature 1..30: note = chr8:38965524-38965554
  misc_feature 1..30: note = Hypo
  source 1..30: mol_type = genomic DNA

SEQ ID NO: 129304 - DNA, 46 bp, Homo sapiens; identical to SEQ ID NO: 99362
  misc_feature 1..46: note = chr8:39695645-39695691
  misc_feature 1..46: note = Hypo
  source 1..46: mol_type = genomic DNA

SEQ ID NO: 129305 - DNA, 77 bp, Homo sapiens; identical to SEQ ID NO: 99363
  misc_feature 1..77: note = chr8:39756231-39756308
  misc_feature 1..77: note = Hypo
  source 1..77: mol_type = genomic DNA

SEQ ID NO: 129306 - DNA, 177 bp, Homo sapiens; identical to SEQ ID NO: 99364
  misc_feature 1..177: note = chr8:40630277-40630454
  misc_feature 1..177: note = Hypo
  source 1..177: mol_type = genomic DNA

SEQ ID NO: 129307 - DNA, 30 bp, Homo sapiens; identical to SEQ ID NO: 99365
  misc_feature 1..30: note = chr8:40707573-40707603
  misc_feature 1..30: note = Hypo
  source 1..30: mol_type = genomic DNA

SEQ ID NO: 129308 - DNA, 53 bp, Homo sapiens; identical to SEQ ID NO: 99366
  misc_feature 1..53: note = chr8:40782590-40782643
  misc_feature 1..53: note = Hypo
  source 1..53: mol_type = genomic DNA

SEQ ID NO: 129309 - DNA, 30 bp, Homo sapiens; identical to SEQ ID NO: 99367
  misc_feature 1..30: note = chr8:41137920-41137950
  misc_feature 1..30: note = Hypo
  source 1..30: mol_type = genomic DNA

SEQ ID NO: 129310 - DNA, 171 bp, Homo sapiens; identical to SEQ ID NO: 99368
  misc_feature 1..171: note = chr8:41146864-41147035
  misc_feature 1..171: note = Hypo
  source 1..171: mol_type = genomic DNA

SEQ ID NO: 129311 - DNA, 1662 bp, Homo sapiens
  misc_feature 1..1662: note = chr8:41165709-41167371
  misc_feature 1..1662: note = Hyper
  source 1..1662: mol_type = genomic DNA
tttgttttttcctcccgtctcagaggttaaaaacttcgatagggactcggagtcctcctagaggagagggaagctcccctgttatttaaagcgcaaggctttgtttcaggtatgggaaaggcgaagttggatcccaggaagagcggctccggggaccacagcgagtccctgcgaggccaaggcgcagagctgccgctcccgggccagccccgccgtgcacctgggtcgcgaggggcgctgagcgatacctgggacagaccagacgcgcttaggaatcacgtgcacagcatgcgagcaacctcgggccctcagtccccagcaccgggacccagcggcgggcgggcgtagggtggcgcgggttctcctgcagctccggccgggggatggagggggcggctcgcgcacgtgggaggaggcagccttaccttggggcttggaggcttcggtggcattgggcggcgtcatggcgatgcagacgtccccctcggggaacttgtcacacttaagcatctcgggccagtagaagccgaagaactgcatgaccggctcgcacgagtcgcgcacggcctcgcagagccagcgacacgggtagatgggccggtccaggcagacgggcgcgaagagcgagcagaggaagacctgggtgccggcgtggcagttcttgttgagcaggggcacccagctgctggcctgctgcttcacctccgccatggtctcgtgctccagcaggttgggcagcaccatcttcttgtagcccacgttgtggcacagccgcaggtccgcggggatgtccacgcactgaggtggcttggtgtagaagcgcccgctctggtacgggccgatgtccgactggaagctcacgtagtcgtactcgctggccgagcccacggccagaagcgccgcgcccagcgccagcagcacgcccagggctgccccgcggcggcccccctcgctgcgcccgatgcccatgccggctctgcgccctgttctccgcgacgtcggggctgcctccgccgcctccccgcgcgcgtcctgccgcaaacttccagggacctccggggacaaaaggcgcagtccccagcgttgcccggctccgcggccgcaagctgctgcccggtccccccggccagtggcggccctcggcctgcggtcggaggcggcgcgggcggggaggcggcgctgcgggctgggtgcgccccggctcccggaggtgcggcgagcaggaaggcgcggggcggcgggcgcgcggcactgactccggaggctgcagggctggagtgcgcggggctcctacggccgagccctcggagccgccccgcgcagccaatcagctcccggcggggcgagccgcactcgttaccacgtccgtcaccggcgcgggagccaatcgcctccctcgcgagcgggttcggtttactagaaccagacgcggctcaacaccccttaaaaaacaaaaccaaaaatacataaataaaagggggaggaggaaagagacaaggggagaaaaagaaggggaatggatcacggcgtggggtggagagagaccagggcggacgctgtaattaactcgcattggcttgcagagaagcggggagcctggatcatacttgcaaacccatgaaattatgaagactttttttttttgagacagtttcgctcttg

SEQ ID NO: 129312 - DNA, 226 bp, Homo sapiens; identical to SEQ ID NO: 99374
  misc_feature 1..226: note = chr8:41424669-41424895
  misc_feature 1..226: note = Hyper
  source 1..226: mol_type = genomic DNA

SEQ ID NO: 129313 - DNA, 37 bp, Homo sapiens; identical to SEQ ID NO: 99375
  misc_feature 1..37: note = chr8:41488146-41488183
  misc_feature 1..37: note = Hypo
  source 1..37: mol_type = genomic DNA

SEQ ID NO: 129314 - DNA, 564 bp, Homo sapiens; identical to SEQ ID NO: 99376
  misc_feature 1..564: note = chr8:41503824-41504388
  misc_feature 1..564: note = Hyper
  source 1..564: mol_type = genomic DNA

SEQ ID NO: 129315 - DNA, 30 bp, Homo sapiens; identical to SEQ ID NO: 41750
  misc_feature 1..30: note = chr8:41510183-41510213
  misc_feature 1..30: note = Hypo
  source 1..30: mol_type = genomic DNA

SEQ ID NO: 129316 - DNA, 195 bp, Homo sapiens
  misc_feature 1..195: note = chr8:41511045-41511240
  misc_feature 1..195: note = Hyper
  source 1..195: mol_type = genomic DNA
cggagtctggagctgcggggtccgcgggggcgctaagggggctactgggttggctgcagcagcgacctgggagaggaaggtgcaggatcgaggcgggagaggcgagccctgagcccagcttccttgggccgtcaccgaatcggtcccagccgcgctgtgcggcccccctgccgtggcccccgggatgggggagga

SEQ ID NO: 129317 - DNA, 109 bp, Homo sapiens; identical to SEQ ID NO: 99380
  misc_feature 1..109: note = chr8:41511443-41511552
  misc_feature 1..109: note = Hyper
  source 1..109: mol_type = genomic DNA

SEQ ID NO: 129318 - DNA, 120 bp, Homo sapiens; identical to SEQ ID NO: 99381
  misc_feature 1..120: note = chr8:41523651-41523771
  misc_feature 1..120: note = Hypo
  source 1..120: mol_type = genomic DNA

SEQ ID NO: 129319 - DNA, 147 bp, Homo sapiens; identical to SEQ ID NO: 99382
  misc_feature 1..147: note = chr8:41530122-41530269
  misc_feature 1..147: note = Hypo
  source 1..147: mol_type = genomic DNA

SEQ ID NO: 129320 - DNA, 203 bp, Homo sapiens; identical to SEQ ID NO: 99383
  misc_feature 1..203: note = chr8:41531574-41531777
  misc_feature 1..203: note = Hypo
  source 1..203: mol_type = genomic DNA

SEQ ID NO: 129321 - DNA, 29 bp, Homo sapiens
  misc_feature 1..29: note = chr8:41535372-41535401
  misc_feature 1..29: note = Hypo
  source 1..29: mol_type = genomic DNA
gccaggattacaagcgtgaaccactgcac

SEQ ID NO: 129322 - DNA, 136 bp, Homo sapiens; identical to SEQ ID NO: 99385
  misc_feature 1..136: note = chr8:41539808-41539944
  misc_feature 1..136: note = Hypo
  source 1..136: mol_type = genomic DNA

SEQ ID NO: 129323 - DNA, 79 bp, Homo sapiens; identical to SEQ ID NO: 99386
  misc_feature 1..79: note = chr8:41540907-41540986
  misc_feature 1..79: note = Hypo
  source 1..79: mol_type = genomic DNA

SEQ ID NO: 129324 - DNA, 62 bp, Homo sapiens; identical to SEQ ID NO: 99387
  misc_feature 1..62: note = chr8:41546283-41546345
  misc_feature 1..62: note = Hypo
  source 1..62: mol_type = genomic DNA

SEQ ID NO: 129325 - DNA, 99 bp, Homo sapiens; identical to SEQ ID NO: 99388
  misc_feature 1..99: note = chr8:41552691-41552790
  misc_feature 1..99: note = Hypo
  source 1..99: mol_type = genomic DNA

SEQ ID NO: 129326 - DNA, 381 bp, Homo sapiens; identical to SEQ ID NO: 99389
  misc_feature 1..381: note = chr8:41553990-41554371
  misc_feature 1..381: note = Hypo
  source 1..381: mol_type = genomic DNA

SEQ ID NO: 129327 - DNA, 107 bp, Homo sapiens; identical to SEQ ID NO: 99390
  misc_feature 1..107: note = chr8:41566310-41566417
  misc_feature 1..107: note = Hypo
  source 1..107: mol_type = genomic DNA

SEQ ID NO: 129328 - DNA, 30 bp, Homo sapiens; identical to SEQ ID NO: 99391
  misc_feature 1..30: note = chr8:41582836-41582866
  misc_feature 1..30: note = Hypo
  source 1..30: mol_type = genomic DNA

SEQ ID NO: 129329 - DNA, 52 bp, Homo sapiens; identical to SEQ ID NO: 41754
  misc_feature 1..52: note = chr8:41594902-41594954
  misc_feature 1..52: note = Hypo
  source 1..52: mol_type = genomic DNA

SEQ ID NO: 129330 - DNA, 30 bp, Homo sapiens; identical to SEQ ID NO: 99393
  misc_feature 1..30: note = chr8:41599293-41599323
  misc_feature 1..30: note = Hypo
  source 1..30: mol_type = genomic DNA

SEQ ID NO: 129331 - DNA, 117 bp, Homo sapiens; identical to SEQ ID NO: 99394
  misc_feature 1..117: note = chr8:41611241-41611358
  misc_feature 1..117: note = Hypo
  source 1..117: mol_type = genomic DNA

SEQ ID NO: 129332 - DNA, 795 bp, Homo sapiens
  misc_feature 1..795: note = chr8:41624546-41625341
  misc_feature 1..795: note = Hyper
  source 1..795: mol_type = genomic DNA
gcggctccacgctcccgcccgtgcccctcttccaggccggccacaagtcccgctgcctcccaaccccggctccagcccctccgcggccgcagccttcaggccagaggaattttcctctggatcctgctagaagcctcggcagcagaagggcagccccagcgcgcgcacccgcacccgccggggaaagttggcgccgggcagccgggcgcggagccacaacccgcaggacggacgcagagccccggccccggccccggccccgatccccgcgccccggccccggccgggcaaccgcgacagctcgtgcactcaccgcagggtctggcccggacctgccctgtcgcgctgccatcgtccggcgcccgcgctgaaatccgagcccggctcccgctccccctcccggttatctgctgggcggcgcggggagcgccagcaagttacgcggcatctggctaaaaatacaggcgccctccactcgccccggcccggccctggccctgcgctctcccgcccgccagcctgccgctaatgggatctcttcattttctctccatgattatgtcagatgggaaagttaatgcgaagcgctctccggagagcaggcacctgctgccaagccctgcgaagggggtgcgcgcgggggcgcgggcgggggtgcagccccagctgcaggtgccggccggcgggctcggggcgggcgtcctgcccctgcggaggggaggcacacacgtccagtggaggtgaggagctccaagctgcatggcctccctccctgcctcccgcctccccgaatgc

SEQ ID NO: 129333 - DNA, 30 bp, Homo sapiens; identical to SEQ ID NO: 99397
  misc_feature 1..30: note = chr8:41632351-41632381
  misc_feature 1..30: note = Hypo
  source 1..30: mol_type = genomic DNA

SEQ ID NO: 129334 - DNA, 25 bp, Homo sapiens
  misc_feature 1..25: note = chr8:41638209-41638234
  misc_feature 1..25: note = Hypo
  source 1..25: mol_type = genomic DNA
atgcctgtgtgtgcacgtgtgcctg

SEQ ID NO: 129335 - DNA, 218 bp, Homo sapiens; identical to SEQ ID NO: 99399
  misc_feature 1..218: note = chr8:41643385-41643603
  misc_feature 1..218: note = Hypo
  source 1..218: mol_type = genomic DNA

SEQ ID NO: 129336 - DNA, 451 bp, Homo sapiens
  misc_feature 1..451: note = chr8:41655043-41655494
  misc_feature 1..451: note = Hyper
  source 1..451: mol_type = genomic DNA
cagaatagggcatgccggtctttcagcaggggcccgccgaagggccttgggggcttgaggaggagcagctggggctggcggactcaccgcagcctctgcggggcctgtgacgtgcgggccaggcccccgagggccttatcggccccagaggcgcttgctgtcgggccgggcgctcccggcacgggcgggcggaggggtggcgcccgcctggggaccgcagattacaagagcacctcctcccccaaccccaggaggccccgctccccaggcctcggccggcgcggacccctggttgccccggggtcgagagcagccggggagagctgagttcagagcccagagttggacatcaggccacacgctgagagggtagtaaatgaaagggagtccggtttagtcgcgggcagggcatctcctcttctgcttgtctaaaagtcgctgggtgcagggg

SEQ ID NO: 129337 - DNA, 141 bp, Homo sapiens; identical to SEQ ID NO: 99402
  misc_feature 1..141: note = chr8:41668167-41668308
  misc_feature 1..141: note = Hypo
  source 1..141: mol_type = genomic DNA

SEQ ID NO: 129338 - DNA, 34 bp, Homo sapiens; identical to SEQ ID NO: 99403
  misc_feature 1..34: note = chr8:41685657-41685691
  misc_feature 1..34: note = Hyper
  source 1..34: mol_type = genomic DNA

SEQ ID NO: 129339 - DNA, 313 bp, Homo sapiens; identical to SEQ ID NO: 99404
  misc_feature 1..313: note = chr8:41686308-41686621
  misc_feature 1..313: note = Hyper
  source 1..313: mol_type = genomic DNA

SEQ ID NO: 129340 - DNA, 64 bp, Homo sapiens; identical to SEQ ID NO: 99405
  misc_feature 1..64: note = chr8:41689272-41689336
  misc_feature 1..64: note = Hypo
  source 1..64: mol_type = genomic DNA

SEQ ID NO: 129341 - DNA, 81 bp, Homo sapiens; identical to SEQ ID NO: 99406
  misc_feature 1..81: note = chr8:41695929-41696010
  misc_feature 1..81: note = Hypo
  source 1..81: mol_type = genomic DNA

SEQ ID NO: 129342 - DNA, 30 bp, Homo sapiens; identical to SEQ ID NO: 99407
  misc_feature 1..30: note = chr8:41707500-41707530
  misc_feature 1..30: note = Hypo
  source 1..30: mol_type = genomic DNA

SEQ ID NO: 129343 - DNA, 361 bp, Homo sapiens
  misc_feature 1..361: note = chr8:41733415-41733776
  misc_feature 1..361: note = Hyper
  source 1..361: mol_type = genomic DNA
ttgccttcatttctccggctgcatccgaggctccccagaggggccggcgcgcgcccgggcgcacactcgcacacctgcccgcgcgcacacacccgcgcctggccccgcgcgcgcacgtcccgcgacctcgcaggttcgcggcccgcaaccggcagggcaggagcttccaccaatcccctcgcctcacgcctcctgcccaaatatagaaaccgacttccttgtcctagagctcggagcggcggccgccctccctcgctgggctcccgaggcggcgctccccaggcgggcgcggggacggccctgtctggcctcaccagcacgtggggcgctgcctgcgctccagccgcggcaccctggcacc

SEQ ID NO: 129344 - DNA, 30 bp, Homo sapiens; identical to SEQ ID NO: 99410
  misc_feature 1..30: note = chr8:41752415-41752445
  misc_feature 1..30: note = Hypo
  source 1..30: mol_type = genomic DNA

SEQ ID NO: 129345 - DNA, 1944 bp, Homo sapiens
  misc_feature 1..1944: note = chr8:41753273-41755217
  misc_feature 1..1944: note = Hyper
  source 1..1944: mol_type = genomic DNA
ttctgctaccagatccggagggtcaggaaaggtgctccctgagaagggtcaaggaagggcaggagcccgactctcgttcagagacacctgggaaagacgctctcttcgtcagagtgggtcacctagggagaagccgggcagagctgcccccccccggcccgctccccggagcctgcagccgcgtttacccaaaccagctctcctggaaagccagcgggtgcggcgcgcccgagcagggcagcccaccacccgcagccggcagccaaggccgggaaagttggtcctagagcagcgcgggcctgccgggtgctgtccaaggtgctgaaaggtctctgcgggcagctggcgggaggattctgcgcgccctcagcctcccggccacccgctctgcccttccagcctgccgccctgtccccttcccggccgcgcagaagcctccgtccctcctctacgcccaccgagccttccccgctcgggtgccgccaactccgccgcaccgggcgccgcgccccaccgcgtcccgggccgcccgacccctgcccccagcagccacttgcaggtgccgcggtcgctgggctttcaccgccgccccctcctaccttcttctttcggtcacgggagcggtttctccgcttcctgttggattcctccttctccttctgctcctggagggcctgcgcctcgatgtctttgattttcttcagctgtttggccgcttgagccatggcgggtcacggcgctcccgtccccgcctcctggacccctagcgctcagcgatccccgaggcgacaccccctaagaaggggaagggggtctctgctccacagaggggacagcgttcgtggcgccccgagggccggctgctgcggggtcgcgggaaggcgaaggcagttccggacgcggagggcgaggggcggctgcccgcggcccgggatggcgctgccgccgcggccggagctcgcttgccggcgcccgggacgggctctgggcagggcccgccgcctccctccctccgcctccctccctctcctgcggcggcggcggcggcgaagcgggggggcgggggcggggaggcggctcgtactgcggcggcggcgggcggtgagcggccgcggaaggggcggattcgggcgctcagcgcgggaaggcccgggggcccggccggcgcggcgaggctgggcgcactgggcgtccgcacggggtcatggcgagcgccgagcttccgcctttgcagagccccgcgccgtcgggcggcgggaacaaagcggccgctctaccccggaccccgctgcgggccgcagggccaagccgggggaagaggggaggctgcggcgggcggcgcgccccgcgcccgggcgacccggcggaccagcgcgcctggcggcggcgagcgcggcgacatcgcgggagcggaggctcggcctagagggcgggcggcagagggcaaggaccgggcttggggagcccccgggcggtggccgctgagggcccggacgcgctactcccgagcccggggtgcggttcctccccgggcgccctcggcgtggggcgcgcgcctccggggctccctggggaagagccggttccccgcgccgcacgctgggagcttgatttgcccctttcagaccatgtgggcctttcatttgcatatttccgaattatagatgaaaacgtatccaggatcaagtgaattgttttcctttgagtcctcttgggacagaaaaggaagtaggtccccgctccagccccgcccgtcccccatccccggcgctcccgcgcacgcctccctggggacgccgcctgcgcccgtgccccgcggggaagagctgcacttgggtccgcagcgccagcccagcctgcggcaggcggagggggcctagggctcagccaaccaccccgtcacgccgcacaggagccagccggggtccccggctcgggagctgc

SEQ ID NO: 129346 - DNA, 33 bp, Homo sapiens; identical to SEQ ID NO: 99414
  misc_feature 1..33: note = chr8:41755524-41755557
  misc_feature 1..33: note = Hyper
  source 1..33: mol_type = genomic DNA

SEQ ID NO: 129347 - DNA, 96 bp, Homo sapiens; identical to SEQ ID NO: 99415
  misc_feature 1..96: note = chr8:41773327-41773423
  misc_feature 1..96: note = Hypo
  source 1..96: mol_type = genomic DNA

SEQ ID NO: 129348 - DNA, 69 bp, Homo sapiens; identical to SEQ ID NO: 99416
  misc_feature 1..69: note = chr8:41910270-41910339
  misc_feature 1..69: note = Hypo
  source 1..69: mol_type = genomic DNA

SEQ ID NO: 129349 - DNA, 211 bp, Homo sapiens; identical to SEQ ID NO: 99417
  misc_feature 1..211: note = chr8:42009840-42010051
  misc_feature 1..211: note = Hyper
  source 1..211: mol_type = genomic DNA

SEQ ID NO: 129350 - DNA, 59 bp, Homo sapiens; identical to SEQ ID NO: 99418
  misc_feature 1..59: note = chr8:42036381-42036440
  misc_feature 1..59: note = Hypo
  source 1..59: mol_type = genomic DNA

SEQ ID NO: 129351 - DNA, 157 bp, Homo sapiens; identical to SEQ ID NO: 99419
  misc_feature 1..157: note = chr8:42044825-42044982
  misc_feature 1..157: note = Hypo
  source 1..157: mol_type = genomic DNA

SEQ ID NO: 129352 - DNA, 30 bp, Homo sapiens; identical to SEQ ID NO: 99420
  misc_feature 1..30: note = chr8:42050976-42051006
  misc_feature 1..30: note = Hypo
  source 1..30: mol_type = genomic DNA

SEQ ID NO: 129353 - DNA, 179 bp, Homo sapiens; identical to SEQ ID NO: 99421
  misc_feature 1..179: note = chr8:42137798-42137977
  misc_feature 1..179: note = Hyper
  source 1..179: mol_type = genomic DNA

SEQ ID NO: 129354 - DNA, 176 bp, Homo sapiens; identical to SEQ ID NO: 99422
  misc_feature 1..176: note = chr8:42144632-42144808
  misc_feature 1..176: note = Hypo
  source 1..176: mol_type = genomic DNA

SEQ ID NO: 129355 - DNA, 30 bp, Homo sapiens; identical to SEQ ID NO: 99423
  misc_feature 1..30: note = chr8:42147491-42147521
  misc_feature 1..30: note = Hypo
  source 1..30: mol_type = genomic DNA

SEQ ID NO: 129356 - DNA, 41 bp, Homo sapiens; identical to SEQ ID NO: 99424
  misc_feature 1..41: note = chr8:42333549-42333590
  misc_feature 1..41: note = Hypo
  source 1..41: mol_type = genomic DNA

SEQ ID NO: 129357 - DNA, 160 bp, Homo sapiens; identical to SEQ ID NO: 99425
  misc_feature 1..160: note = chr8:42333890-42334050
  misc_feature 1..160: note = Hypo
  source 1..160: mol_type = genomic DNA

SEQ ID NO: 129358 - DNA, 25 bp, Homo sapiens
  misc_feature 1..25: note = chr8:42399256-42399281
  misc_feature 1..25: note = Hypo
  source 1..25: mol_type = genomic DNA
caatatgtcaaataccggccgggcg

SEQ ID NO: 129359 - DNA, 30 bp, Homo sapiens; identical to SEQ ID NO: 99427
  misc_feature 1..30: note = chr8:42600848-42600878
  misc_feature 1..30: note = Hypo
  source 1..30: mol_type = genomic DNA

SEQ ID NO: 129360 - DNA, 82 bp, Homo sapiens; identical to SEQ ID NO: 99428
  misc_feature 1..82: note = chr8:42661169-42661251
  misc_feature 1..82: note = Hypo
  source 1..82: mol_type = genomic DNA

SEQ ID NO: 129361 - DNA, 30 bp, Homo sapiens; identical to SEQ ID NO: 15108
  misc_feature 1..30: note = chr8:42699267-42699297
  misc_feature 1..30: note = Hypo
  source 1..30: mol_type = genomic DNA

SEQ ID NO: 129362 - DNA, 77 bp, Homo sapiens; identical to SEQ ID NO: 99430
  misc_feature 1..77: note = chr8:42749678-42749755
  misc_feature 1..77: note = Hypo
  source 1..77: mol_type = genomic DNA

SEQ ID NO: 129363 - DNA, 17 bp, Homo sapiens
  misc_feature 1..17: note = chr8:42749995-42750012
  misc_feature 1..17: note = Hypo
  source 1..17: mol_type = genomic DNA
cacgtatgtgtaatttc

SEQ ID NO: 129364 - DNA, 274 bp, Homo sapiens
  misc_feature 1..274: note = chr8:43102377-43102651
  misc_feature 1..274: note = Hyper
  source 1..274: mol_type = genomic DNA
ctgctccatcgaccacgagtacccggatcccgggtaccacacctgggacgcggaactgcggaagatccacagggcggcagtgaggggcgacgccgcagaggtggagcgccgccgcagaggtcgagcgccgccagatgcgcagaagccgggacttgtacgcccgcgacaggaaagacaggcagcggggcctcagctccaggtgggagggggccctaggcccggcttcccgcagccccgcagccccgcagccccgcagccccgtagccccgaagcc

SEQ ID NO: 129365 - DNA, 48 bp, Homo sapiens; identical to SEQ ID NO: 99434
  misc_feature 1..48: note = chr8:43400747-43400795
  misc_feature 1..48: note = Hypo
  source 1..48: mol_type = genomic DNA

SEQ ID NO: 129366 - DNA, 60 bp, Homo sapiens; identical to SEQ ID NO: 99435
  misc_feature 1..60: note = chr8:43401723-43401783
  misc_feature 1..60: note = Hypo
  source 1..60: mol_type = genomic DNA

SEQ ID NO: 129367 - DNA, 48 bp, Homo sapiens; identical to SEQ ID NO: 99436
  misc_feature 1..48: note = chr8:43404086-43404134
  misc_feature 1..48: note = Hypo
  source 1..48: mol_type = genomic DNA

SEQ ID NO: 129368 - DNA, 192 bp, Homo sapiens; identical to SEQ ID NO: 99437
  misc_feature 1..192: note = chr8:43416667-43416859
  misc_feature 1..192: note = Hypo
  source 1..192: mol_type = genomic DNA

SEQ ID NO: 129369 - DNA, 177 bp, Homo sapiens; identical to SEQ ID NO: 99439
  misc_feature 1..177: note = chr8:46935227-46935404
  misc_feature 1..177: note = Hypo
  source 1..177: mol_type = genomic DNA

SEQ ID NO: 129370 - DNA, 30 bp, Homo sapiens; identical to SEQ ID NO: 99440
  misc_feature 1..30: note = chr8:47015663-47015693
  misc_feature 1..30: note = Hypo
  source 1..30: mol_type = genomic DNA

SEQ ID NO: 129371 - DNA, 30 bp, Homo sapiens; identical to SEQ ID NO: 99441
  misc_feature 1..30: note = chr8:47015813-47015843
  misc_feature 1..30: note = Hypo
  source 1..30: mol_type = genomic DNA

SEQ ID NO: 129372 - DNA, 48 bp, Homo sapiens; identical to SEQ ID NO: 99442
  misc_feature 1..48: note = chr8:47016307-47016355
  misc_feature 1..48: note = Hypo
  source 1..48: mol_type = genomic DNA

SEQ ID NO: 129373 - DNA, 30 bp, Homo sapiens; identical to SEQ ID NO: 99443
  misc_feature 1..30: note = chr8:47021923-47021953
  misc_feature 1..30: note = Hypo
  source 1..30: mol_type = genomic DNA

SEQ ID NO: 129374 - DNA, 179 bp, Homo sapiens; identical to SEQ ID NO: 99444
  misc_feature 1..179: note = chr8:47093235-47093414
  misc_feature 1..179: note = Hypo
  source 1..179: mol_type = genomic DNA

SEQ ID NO: 129375 - DNA, 41 bp, Homo sapiens; identical to SEQ ID NO: 99445
  misc_feature 1..41: note = chr8:47122214-47122255
  misc_feature 1..41: note = Hypo
  source 1..41: mol_type = genomic DNA

SEQ ID NO: 129376 - DNA, 183 bp, Homo sapiens; identical to SEQ ID NO: 99446
  misc_feature 1..183: note = chr8:47138568-47138751
  misc_feature 1..183: note = Hypo
  source 1..183: mol_type = genomic DNA

SEQ ID NO: 129377 - DNA, 183 bp, Homo sapiens; identical to SEQ ID NO: 41768
  misc_feature 1..183: note = chr8:47155037-47155220
  misc_feature 1..183: note = Hypo
  source 1..183: mol_type = genomic DNA

SEQ ID NO: 129378 - DNA, 86 bp, Homo sapiens; identical to SEQ ID NO: 99448
  misc_feature 1..86: note = chr8:47159728-47159814
  misc_feature 1..86: note = Hypo
  source 1..86: mol_type = genomic DNA

SEQ ID NO: 129379 - DNA, 30 bp, Homo sapiens; identical to SEQ ID NO: 99449
  misc_feature 1..30: note = chr8:47161038-47161068
  misc_feature 1..30: note = Hypo
  source 1..30: mol_type = genomic DNA

SEQ ID NO: 129380 - DNA, 108 bp, Homo sapiens; identical to SEQ ID NO: 41769
  misc_feature 1..108: note = chr8:47334490-47334598
  misc_feature 1..108: note = Hypo
  source 1..108: mol_type = genomic DNA

SEQ ID NO: 129381 - DNA, 49 bp, Homo sapiens; identical to SEQ ID NO: 99451
  misc_feature 1..49: note = chr8:47355877-47355926
  misc_feature 1..49: note = Hypo
  source 1..49: mol_type = genomic DNA

SEQ ID NO: 129382 - DNA, 177 bp, Homo sapiens; identical to SEQ ID NO: 99452
  misc_feature 1..177: note = chr8:47357885-47358062
  misc_feature 1..177: note = Hypo
  source 1..177: mol_type = genomic DNA

SEQ ID NO: 129383 - DNA, 162 bp, Homo sapiens; identical to SEQ ID NO: 99453
  misc_feature 1..162: note = chr8:47829382-47829544
  misc_feature 1..162: note = Hyper
  source 1..162: mol_type = genomic DNA

SEQ ID NO: 129384 - DNA, 255 bp, Homo sapiens; identical to SEQ ID NO: 99454
  misc_feature 1..255: note = chr8:48021889-48022144
  misc_feature 1..255: note = Hypo
  source 1..255: mol_type = genomic DNA

SEQ ID NO: 129385 - DNA, 130 bp, Homo sapiens; identical to SEQ ID NO: 99455
  misc_feature 1..130: note = chr8:48044980-48045110
  misc_feature 1..130: note = Hypo
  source 1..130: mol_type = genomic DNA

SEQ ID NO: 129386 - DNA, 527 bp, Homo sapiens; identical to SEQ ID NO: 31932
  misc_feature 1..527: note = chr8:48100170-48100697
  misc_feature 1..527: note = Hyper
  source 1..527: mol_type = genomic DNA

SEQ ID NO: 129387 - DNA, 191 bp, Homo sapiens; identical to SEQ ID NO: 99457
  misc_feature 1..191: note = chr8:48294168-48294359
  misc_feature 1..191: note = Hypo
  source 1..191: mol_type = genomic DNA

SEQ ID NO: 129388 - DNA, 30 bp, Homo sapiens; identical to SEQ ID NO: 99465
  misc_feature 1..30: note = chr8:48601821-48601851
  misc_feature 1..30: note = Hypo
  source 1..30: mol_type = genomic DNA

SEQ ID NO: 129389 - DNA, 26 bp, Homo sapiens
  misc_feature 1..26: note = chr8:48675264-48675290
  misc_feature 1..26: note = Hypo
  source 1..26: mol_type = genomic DNA
ttttctttctccgtggcacataaagt

SEQ ID NO: 129390 - DNA, 147 bp, Homo sapiens; identical to SEQ ID NO: 99467
  misc_feature 1..147: note = chr8:48676735-48676882
  misc_feature 1..147: note = Hypo
  source 1..147: mol_type = genomic DNA

SEQ ID NO: 129391 - DNA, 45 bp, Homo sapiens; identical to SEQ ID NO: 41774
  misc_feature 1..45: note = chr8:48796372-48796417
  misc_feature 1..45: note = Hypo
  source 1..45: mol_type = genomic DNA

SEQ ID NO: 129392 - DNA, 30 bp, Homo sapiens; identical to SEQ ID NO: 99469
  misc_feature 1..30: note = chr8:49058263-49058293
  misc_feature 1..30: note = Hypo
  source 1..30: mol_type = genomic DNA

SEQ ID NO: 129393 - DNA, 30 bp, Homo sapiens; identical to SEQ ID NO: 99470
  misc_feature 1..30: note = chr8:49172784-49172814
  misc_feature 1..30: note = Hypo
  source 1..30: mol_type = genomic DNA

SEQ ID NO: 129394 - DNA, 30 bp, Homo sapiens; identical to SEQ ID NO: 99471
  misc_feature 1..30: note = chr8:49195117-49195147
  misc_feature 1..30: note = Hypo
  source 1..30: mol_type = genomic DNA

SEQ ID NO: 129395 - DNA, 751 bp, Homo sapiens
  misc_feature 1..751: note = chr8:49292866-49293617
  misc_feature 1..751: note = Hyper
  source 1..751: mol_type = genomic DNA
aaaggttgacaagagcggggctgggctccggcatgggcgcaaaaacaccagtgcggaggagttctcgggaccccccggggctgcggggccttgcggggacagccccaggcccggagctgcagaaacacccagaccccgcgcctcccggaaccacgcgtctctgtgcacagacattcctgggggcaggctcctgtcctttaacacagtctcaaaggagtcttcaaaaacaaaaagtttacaagcactgatagggaaaacagaaggatgataacaccaagagggactttcccgggagaggacggcttccagggactgagaaaggatgggcaagtgggcggggcccggcgccgtgcgggcagggctggcgccgggagtccccagactcccccgcagtgggaagcacctctcccattcacgccgggcaggacacctggccgggcgggggaggcagcgcaagggccggccggggagtacgggactcgagccggggacctgaggcaggagccaagcatcgtcgcagggcaaccagcagaacggagagggaggcgcgggggcgaaggctggcgggagccgcgctgagggcaggagcccggagccccctagggcagcgccgatccgcccgccccgtcccgccgagctgggcctccgtctgtggcctgcgcagccagggtcgccaagccgcctggaatggctcaggcttccaaaaggagcaggcgccaaaaagagctttgcccgccgggtgatggagatc

SEQ ID NO: 129396 - DNA, 332 bp, Homo sapiens; identical to SEQ ID NO: 99474
  misc_feature 1..332: note = chr8:49309314-49309646
  misc_feature 1..332: note = Hyper
  source 1..332: mol_type = genomic DNA

SEQ ID NO: 129397 - DNA, 306 bp, Homo sapiens; identical to SEQ ID NO: 99475
  misc_feature 1..306: note = chr8:49334982-49335288
  misc_feature 1..306: note = Hypo
  source 1..306: mol_type = genomic DNA

SEQ ID NO: 129398 - DNA, 90 bp, Homo sapiens; identical to SEQ ID NO: 99476
  misc_feature 1..90: note = chr8:49382293-49382383
  misc_feature 1..90: note = Hypo
  source 1..90: mol_type = genomic DNA

SEQ ID NO: 129399 - DNA, 326 bp, Homo sapiens; identical to SEQ ID NO: 99477
  misc_feature 1..326: note = chr8:49390299-49390625
  misc_feature 1..326: note = Hypo
  source 1..326: mol_type = genomic DNA

SEQ ID NO: 129400 - DNA, 30 bp, Homo sapiens; identical to SEQ ID NO: 99478
  misc_feature 1..30: note = chr8:49418760-49418790
  misc_feature 1..30: note = Hypo
  source 1..30: mol_type = genomic DNA

SEQ ID NO: 129401 - DNA, 523 bp, Homo sapiens
  misc_feature 1..523: note = chr8:49468668-49469191
  misc_feature 1..523: note = Hyper
  source 1..523: mol_type = genomic DNA
ttaggaacatttccccggtcggtcattagcgcgcgctctccccgcgcccagggtgcccccgtgcccagggtgcccccgcccggcgcctccgcggtcccctcccgcgcgcacctttccgagtgccagtggggcggccccgagaccgcaattgctctggcccggattgacgagcctccgatgcccatttactgcgcgcggcagccactctggagccgcggcacatctggatggagtcagctgcctagcgccaggggccagcacggcccagccagcggagcgcggcggtgagcgctagggaggccggcgcccgggccgcctccgcggccgaccccctgtccccacccgagcaggatttcctgatgtaaacacagcggctctgcgagaacagagctgctctcctgaatgtgtcatttagtgttctttatctgcttggggtcagcatagcgacttagaaaaacagcagtcttgctttgaatttaaacagcgaagaagccagagggtcctgttccgtatggggggaggg

SEQ ID NO: 129402 - DNA, 67 bp, Homo sapiens; identical to SEQ ID NO: 99482
  misc_feature 1..67: note = chr8:49496353-49496420
  misc_feature 1..67: note = Hypo
  source 1..67: mol_type = genomic DNA

SEQ ID NO: 129403 - DNA, 30 bp, Homo sapiens; identical to SEQ ID NO: 99483
  misc_feature 1..30: note = chr8:49527456-49527486
  misc_feature 1..30: note = Hypo
  source 1..30: mol_type = genomic DNA

SEQ ID NO: 129404 - DNA, 45 bp, Homo sapiens; identical to SEQ ID NO: 99484
  misc_feature 1..45: note = chr8:49547039-49547084
  misc_feature 1..45: note = Hypo
  source 1..45: mol_type = genomic DNA

SEQ ID NO: 129405 - DNA, 268 bp, Homo sapiens; identical to SEQ ID NO: 99486
  misc_feature 1..268: note = chr8:49571915-49572183
  misc_feature 1..268: note = Hypo
  source 1..268: mol_type = genomic DNA

SEQ ID NO: 129406 - DNA, 267 bp, Homo sapiens; identical to SEQ ID NO: 41778
  misc_feature 1..267: note = chr8:49608941-49609208
  misc_feature 1..267: note = Hypo
  source 1..267: mol_type = genomic DNA

SEQ ID NO: 129407 - DNA, 36 bp, Homo sapiens; identical to SEQ ID NO: 31938
  misc_feature 1..36: note = chr8:49647817-49647853
  misc_feature 1..36: note = Hyper
  source 1..36: mol_type = genomic DNA

SEQ ID NO: 129408 - DNA, 30 bp, Homo sapiens; identical to SEQ ID NO: 99490
  misc_feature 1..30: note = chr8:49747114-49747144
  misc_feature 1..30: note = Hypo
  source 1..30: mol_type = genomic DNA

SEQ ID NO: 129409 - DNA, 30 bp, Homo sapiens; identical to SEQ ID NO: 41779
  misc_feature 1..30: note = chr8:49773216-49773246
  misc_feature 1..30: note = Hypo
  source 1..30: mol_type = genomic DNA

SEQ ID NO: 129410 - DNA, 465 bp, Homo sapiens
  misc_feature 1..465: note = chr8:49782672-49783137
  misc_feature 1..465: note = Hyper
  source 1..465: mol_type = genomic DNA
ggaatgcccaagcttcgcccccggctaaacacccccttggcgtccgcctgggggtccccatgaaagtccccgcacgccctccccggccccgccctcctcagagcgtgggccccgcgcgccgccaccgcccggccgggaggcgcggggctccctagaaggctcgggcatgtcggagggagccgcggtgcagagacttgccacgcggctgcccgggcggcgcgcgctggagcagctttgtttcctctgctcccgacgggcatcctgccctgcggaacacccacccgagccctgcgcgggaggggcggccgggaggcgcgcgggcatgcggaggggaaacagggctgcagcttcaagcccaggcaggacgcccttagtcaccttatcggaaagtgggcagcgccgcgtctccggttagtcagagccccaggtaaataaagagctcggtgtctgcggggctctggcctc

SEQ ID NO: 129411 - DNA, 288 bp, Homo sapiens; identical to SEQ ID NO: 99494
  misc_feature 1..288: note = chr8:49808681-49808969
  misc_feature 1..288: note = Hypo
  source 1..288: mol_type = genomic DNA

SEQ ID NO: 129412 - DNA, 260 bp, Homo sapiens; identical to SEQ ID NO: 99495
  misc_feature 1..260: note = chr8:49833748-49834008
  misc_feature 1..260: note = Hyper
  source 1..260: mol_type = genomic DNA

SEQ ID NO: 129413 - DNA, 396 bp, Homo sapiens; identical to SEQ ID NO: 99496
  misc_feature 1..396: note = chr8:49834319-49834715
  misc_feature 1..396: note = Hyper
  source 1..396: mol_type = genomic DNA

SEQ ID NO: 129414 - DNA, 222 bp, Homo sapiens; identical to SEQ ID NO: 41781
  misc_feature 1..222: note = chr8:49959230-49959452
  misc_feature 1..222: note = Hypo
  source 1..222: mol_type = genomic DNA

SEQ ID NO: 129415 - DNA, 120 bp, Homo sapiens; identical to SEQ ID NO: 99498
  misc_feature 1..120: note = chr8:50015571-50015691
  misc_feature 1..120: note = Hypo
  source 1..120: mol_type = genomic DNA

SEQ ID NO: 129416 - DNA, 99 bp, Homo sapiens; identical to SEQ ID NO: 99499
  misc_feature 1..99: note = chr8:50101810-50101909
  misc_feature 1..99: note = Hypo
  source 1..99: mol_type = genomic DNA

SEQ ID NO: 129417 - DNA, 156 bp, Homo sapiens; identical to SEQ ID NO: 41783
  misc_feature 1..156: note = chr8:50314445-50314601
  misc_feature 1..156: note = Hypo
  source 1..156: mol_type = genomic DNA

SEQ ID NO: 129418 - DNA, 58 bp, Homo sapiens; identical to SEQ ID NO: 41784
  misc_feature 1..58: note = chr8:50377787-50377845
  misc_feature 1..58: note = Hypo
  source 1..58: mol_type = genomic DNA

SEQ ID NO: 129419 - DNA, 18 bp, Homo sapiens
  misc_feature 1..18: note = chr8:50378196-50378214
  misc_feature 1..18: note = Hypo
  source 1..18: mol_type = genomic DNA
aaccgcctgtagacggca

SEQ ID NO: 129420 - DNA, 23 bp, Homo sapiens
  misc_feature 1..23: note = chr8:50482465-50482488
  misc_feature 1..23: note = Hypo
  source 1..23: mol_type = genomic DNA
accgtgcccggccatgttgttca

SEQ ID NO: 129421 - DNA, 1817 bp, Homo sapiens
  misc_feature 1..1817: note = chr8:50822066-50823883
  misc_feature 1..1817: note = Hyper
  source 1..1817: mol_type = genomic DNA
cataaccttaagcaacgttttcacatggactgaaaagcaaaagacccccttaaaaattagcctcaagcagcagatactctctttttaggtttgtgtgtctccgtgaggtcagatggattccccaaacacggttttagagagaatcacaacctttaatagatcctctgttaaaaaagactgttagagaaagttgaccaagggcttcgttccacggcgaccgtttcctgcgtgtgcagctccacacagcgaccgcggcctgcaatgtgcggagcacagcgcggccccttccagccggagctcgcgagccgcggtggcggctggtggccaccccagggaaataaagccgttgctgctgcagcaaaatggctcaaagtccaaccaaagtctggccttttcctgtgagtaaatacgcggcctgtttggttttccgtcccgagtgattcccggctcagtaacgtttctcctccagggagcccactggaactccactggctgtgccgcctcctcgcccgtcccccgcgcgcgccgcaggccggtgcttggagagcgcaatgtccccgggagggaagatcccctacctggaatggatggttccagaccagcgggaacgcgctctaatccttgatggaagcaagcgtgggaggaaagcacaacgtctaggacttccctgtagtgtcagaacaggaagaagaacctgagaagtcgccggggaagggaggccaggagcaggcgtccggccccttcccacagcccgggagaaattagtgttgcgccccgcccctcccggacccccgtccccaccacacacaccagcgcccctcaccagtctttctcgaatttcctctcatgtctatcaataacctccttgtgcagaaatctacactgcacaagttaggagtctgcaagggcgggcggtgttacagtctcgctctttccattttccccttttactccacatagtttcaaaggtccacatggccctggttttgaccagttttccaacagtttcaacgttatgtatttcaacttcccgtctcagttcactggcgtctgcacccgttgccgagtgtgggtggctgagccctgggtgacagcactcgggaccacgcacccatacccttctttatgctcgttgtcagccagttgccaagagcgggagtgaagagcctgcaaggcccgggagagcgcggattccggagtagggaggcgagggggcagcgtgggagaccagagggaaaatgggctgaaaagccaacaaaaaaaacaacgtaaattgggctttgctctggctttacaaaggcagagattgtcgagccctctgactgtctttgtgccttctttatcccgtcctttgtgaaataagccgttttctgcccccactgcaggagcctaggctgtgggcgactcgctagcactgccctgggcctccaagctgcctgctcgctgagctcagcgctgacactcacaggagctgcgttcgccggatcctctgagaggctctgcaacgatcccgatccaattcagcagcgttttaaaaggtagccgagtgcagatgctttttcctgtctttttcattctttcattctctgtcttttaaaattttaacaataacctatcgtttccgcgtggagggtctaagaatcttcactgggtttaatttaggaatttcaaattgggtttctcaaaatttgaatgtggtccccttaattggtaatcaagattgcggagttttccaaaatattccttttcatcttatgtaattaaagatccacgagctttccaaagaagctctggattttccacggtacaaatctata

SEQ ID NO: 129422 - DNA, 275 bp, Homo sapiens
  misc_feature 1..275: note = chr8:50824134-50824409
  misc_feature 1..275: note = Hyper
  source 1..275: mol_type = genomic DNA
gaaaaaaaaaagaaccggaggggagaaggctagggcggaagacaaggaagctgctgcttggattcgctggtggaggaaagtgcgacctggacctgcgcttaggggctcccgtccccttacttcagcaccagaggggatggacagcgtctccggactgagctgcagccacagggacggaactacgctgccgccgccgctgtccttgccgccactgtcgtcgccacgggcagctgggctacttgctcctcgcagctaaaaggcggtgcctcctatta

SEQ ID NO: 129423 - DNA, 44 bp, Homo sapiens; identical to SEQ ID NO: 99508
  misc_feature 1..44: note = chr8:52183842-52183886
  misc_feature 1..44: note = Hypo
  source 1..44: mol_type = genomic DNA

SEQ ID NO: 129424 - DNA, 18 bp, Homo sapiens
  misc_feature 1..18: note = chr8:52230574-52230592
  misc_feature 1..18: note = Hypo
  source 1..18: mol_type = genomic DNA
gcccggccagtaattgtc

SEQ ID NO: 129425 - DNA, 34 bp, Homo sapiens; identical to SEQ ID NO: 15119
  misc_feature 1..34: note = chr8:52432891-52432925
  misc_feature 1..34: note = Hypo
  source 1..34: mol_type = genomic DNA

SEQ ID NO: 129426 - DNA, 143 bp, Homo sapiens; identical to SEQ ID NO: 99511
  misc_feature 1..143: note = chr8:53352268-53352411
  misc_feature 1..143: note = Hypo
  source 1..143: mol_type = genomic DNA

SEQ ID NO: 129427 - DNA, 157 bp, Homo sapiens; identical to SEQ ID NO: 99512
  misc_feature 1..157: note = chr8:53416425-53416582
  misc_feature 1..157: note = Hypo
  source 1..157: mol_type = genomic DNA

SEQ ID NO: 129428 - DNA, 49 bp, Homo sapiens; identical to SEQ ID NO: 9511
  misc_feature 1..49: note = chr8:53477121-53477170
  misc_feature 1..49: note = Hyper
  source 1..49: mol_type = genomic DNA

SEQ ID NO: 129429 - DNA, 1232 bp, Homo sapiens
  misc_feature 1..1232: note = chr8:53477408-53478640
  misc_feature 1..1232: note = Hyper
  source 1..1232: mol_type = genomic DNA
gatcccattgccagccggatttctttacttaactctcaaccgtggtaaatctaattcgcttacgacctctttccgagagctgggaatctgcagagatgctctgttttctgctgtactaatctcaggcttcccaaagcgagtgcctcgcccagctcctaggggaatccacggagccccaggcgcagggcaaaggatggggcgggatggggacatcgtacctgcgctccgggagccgctgggagtccggccggccccggccgcggggaggaaaagcaacggcttgggctccttatccgtgacgcgcgctcccctgcgcccccggggcctcccgtgggctccgtgcggggacaaagccagcgccagcaggaagagtgcgggcaaaggggcgccgggcttaaggggccgcatgttcgcaagccgggaggagagagcgggagactccgggaggatcccgacgcaggtccggagggtgcgcggcccaagagaaggccagcgggaccacagcgcggctacgcggccggccgcagtcttcaccgcgcgcctgcccttgtctacgtcccgggggtcggctggagctgcactgggactcggtcctcagtgtgccgaagcctaagcgctgcggggcgcggggcgggaacgggaggcggtgcctggggccacggggtcgtcccccaggatgagggcgtgtcccagcgcgcgggaccctcggaagtccgcgctgggccgggcgggcaccagcctcggactcagcgggtctcagggctccctgcgcaacgcctgcctcggatccggaccccgggctcgctctctggtcgccgtccccgggaggacccagtagggtaactgccgcgtcgccccggcggttctccctgggctctgtctcccgccgcctccaccccccgagcctcggggtccgtcacggcttcccctggctggcggggtcagtagaacccgcggcgcctaggtccggacggaaaaaagcagggccggggtgcggcctggatgagcggagatctccgcgccttgggctcaaaggtgcggggtgcgctctgctgccgagcccctgctcgctcaggaacactggccacgccgtcacgccagccgcccctgccccaggtctggaggcccgacctgctctcctaggcgcagcaccgcgttctcttccgcgtgggggagcggcgggcggaagaggtctggggctgggcaccggggacacgcgcccagctcccctg

SEQ ID NO: 129430 - DNA, 30 bp, Homo sapiens; identical to SEQ ID NO: 99518
  misc_feature 1..30: note = chr8:53756040-53756070
  misc_feature 1..30: note = Hypo
  source 1..30: mol_type = genomic DNA

SEQ ID NO: 129431 - DNA, 30 bp, Homo sapiens; identical to SEQ ID NO: 41787
  misc_feature 1..30: note = chr8:53805607-53805637
  misc_feature 1..30: note = Hypo
  source 1..30: mol_type = genomic DNA

SEQ ID NO: 129432 - DNA, 20 bp, Homo sapiens
  misc_feature 1..20: note = chr8:53843008-53843028
  misc_feature 1..20: note = Hypo
  source 1..20: mol_type = genomic DNA
acatgcgagttttaaaatca

SEQ ID NO: 129433 - DNA, 152 bp, Homo sapiens
  misc_feature 1..152: note = chr8:53852136-53852288
  misc_feature 1..152: note = Hyper
  source 1..152: mol_type = genomic DNA
acaggtagcagagagcgctcacgtggaggaggtttggggcgccgcggcgccacccccacccctcctcgggaccgcgcctatttctaaagttacacgtcgacgaactaacctatgctttaaattcctctttccagccccgtgagtccgcggcg

SEQ ID NO: 129434 - DNA, 41 bp, Homo sapiens
  misc_feature 1..41: note = chr8:53852490-53852531
  misc_feature 1..41: note = Hyper
  source 1..41: mol_type = genomic DNA
gccctggcccgccaacgcatcgggcccggacccggcgctga

SEQ ID NO: 129435 - DNA, 895 bp, Homo sapiens
  misc_feature 1..895: note = chr8:53853564-53854459
  misc_feature 1..895: note = Hyper
  source 1..895: mol_type = genomic DNA
ctcgcgccccatacccgacctagcagatcggaagcgctgcgactgtgcccgcaggttgaccttgccaagccctccaggtgatgcgcggccatgccgggtgaggagaactgaggctgagatcgccacactgagggctccctaaagccgaggtggaggaagaggagggtagaggaggagggcggtattgctgggaaccgccccctccctgccctgctccctgctgccccacccgagccctggcagtctggaacctggctggagtcggaactctccgcgccttcgaagggaggcccgaggacgctgccggcgcccccaggcgtcggctccgcgcggcccctgctgtagctggcgcacagccccggcgggtccccttgtcctccgcgcgctctgggaagacggtcaggcgcgcgcgtttggcgcccacccctgtgagacccgcttggcctggcgccgcgggcggggaccgctgccgaggccgccagcgcctcttcaactggggaaaacacaacaactcgggatgccccatcggagtgtgtatacacctgtgtgtgtgtgtgtgtggtgtgcgcgcgtttgcggaggcatgaaatgcggggaaagaggctggcgcttggcagtgactgcctagaatatgatacgaatagtgatccttctttctgtctgcccctactccttttctttgccttttccctttcctatccgtgatctcccctgaaaatgtcagactcccggagcaaggaacccggagtagcccgggcgcgcggttccggcgccccctggaggagccagcggccgagtgcttagcgtcggaggatcgcggggctttgtggtggagcactccggctgagcgcgcttcacagcgctgtggcacactggtcatcgttgcttatagagg

SEQ ID NO: 129436 - DNA, 1286 bp, Homo sapiens
  misc_feature 1..1286: note = chr8:54163316-54164602
  misc_feature 1..1286: note = Hyper
  source 1..1286: mol_type = genomic DNA
gcgctgcgctgtccccgcgctcaccggatgatcacgaacatgaccagcgagttgcccaccaagcccacgacgaacactacggagtagaccgccgtgatgatgaccgggatggccggggagatgtgcgcgggctccagctgcgcgtcctccgagccggcgctgccgttgctgtcgggctcggcccagccgggaaaccaggcgctgctgttggggggcaggcaggcgctcggggcgcaggtagggcccggctccccgcggaagatctggatcggggagtccatggtggggcgattgcagcaggaaggcgaggacaggcggcacctgcggcgctgcgggagcgaaagaaccggctggacgcggagaggcaaactttgcccgcgccctggccagcggcgctggggacccggagcctgcggactcccacccgggccgcaagtcgccgggggcaggacagggagaacggacttctcgctgcctttccggccagcaggcgcgccgctgggtgccagagaggggcgaagagcgctcgctccttctcccccagcccctgaggtgcctccctcaccaattctaggcaccggcccctggtggaactgtccccagactgcctgagtccccagggtcaagcccccttcccacctcccagcacggagctctacctagaactgcacctcgaaagcccaaagcttacctatggttcccagagacaggcgaaggcgaggttttttacgggacgccctggtaggtgctgaaccgcgcgctcacgagtcccgctcagctcttggcatcacctgctctcggaccccggccccgctctccgcccgagggctgctgttccgccgagcgcagcccccgcctctcagcgcacgtctcccactactggcggcggctctgcggggcggggcggggcgggaccggcgggacgcagccgggacgcggctgggcgctgggggcctgcgggcggagagctcgtctggtgcgcccgccccaggccggcaggtccctgccccgccccgcccgcccggagtcagcccccagctccccagcctcccagccccgcgtcccctccagccccgcaggctcgcccggcccactaactgcccgagcggcacaccgcctggtccccggccatgcagccttccccaagacctgagactgagccatttagatttagtaaaaaggaggagcatgcctatttagtgcaagtatgcacctggattttcatattgtgtctagaacttcttatctgcatagttcgcagtcaggaactacgcttattagaatgg

SEQ ID NO: 129437 - DNA, 39 bp, Homo sapiens; identical to SEQ ID NO: 31961
  misc_feature 1..39: note = chr8:54570523-54570562
  misc_feature 1..39: note = Hyper
  source 1..39: mol_type = genomic DNA

SEQ ID NO: 129438 - DNA, 214 bp, Homo sapiens; identical to SEQ ID NO: 99527
  misc_feature 1..214: note = chr8:54582655-54582869
  misc_feature 1..214: note = Hypo
  source 1..214: mol_type = genomic DNA

SEQ ID NO: 129439 - DNA, 1708 bp, Homo sapiens
  misc_feature 1..1708: note = chr8:54789099-54790807
  misc_feature 1..1708: note = Hyper
  source 1..1708: mol_type = genomic DNA
tgaagtgcagcccttcgggcagctgaaggtctttctgcagataacttttctcagatcgaattttttggctacattgatactcttcggctctgtccttgccagaagttcggaaggattccagcgccccacaccttgcttgattcaccctcatcccctcccctaactggagaagccgctgggtcccgcgccaggctcgcggtggcttcagagtagcaggggagcaggcggctgatccggaggccagtgtggggccggcaagcggtgactgtctccagaggagcaaaggagccgagtcttgtttttcttggatcaggtttgggacttttattctgtctgaccatttccaccacttgcctcacaagagtctctgtctcgaagcacaggaccgaagcaaaatgcctaatgaagcgtgcctgaggaaggggcaggggcttgcaagtgacttgggaagaaggactggggcgaagggagaaaggaggttacgagttcgcacgttctcacaaaaccatttgaaaacatgagctggagacgccaaattctgggacccacgaaaggctttggagctcgctcgggctcctcgaagttgggcgtgcgtcgcagaacagtgctgggcgctctctttcagcattttcggcttttttcaagcccttgcgtagggtcgggaaggccgtgggtgggctcagtcaggctttaggtcgccaggaacccggctggtcctctctcgacttcttagcgtggggtcccgccggccctgccgcccgtggccgccgaagttcccgccctcgccgagggccctcgctccggagtggggcgcagacgcggccgccggcccgcagtcccccgcaggtgccgcccaggactagctgcccggcggaggccgagcacgcttggcggcagctgagcctccaccccaagccccagccggaggggcgcgtcccctgtcctcctcccgagcgagacgaacgctcagcagctcgttccctgggcgccaagaccgatttccaagtcgcccactttccccctcgagggagctgttggcgcttctccagaagcctcctcggctcccagctccagcccctaaaataaaagcaccttgccagagagcgggggaggggagcagctgaacgaggagaatgaaaatactgggagaacgaccccattctccaggaaaaggtaatgaggggaagtgaaacagtgtgaacttactcggaaatgcaaaccgagttcaactcacccaggagcaaacaaacgacagcaagacaaatcagccaccgcactcgcggcttcccagaaagggcctcatgaatgagaatgggttgctaggtttccttccctctctcctgacaatcgcttcccacaagacttccaccgccgaaagaatacaggccgggcctggtgactgcggagtgagggaaccgcgccaggcccacgaggccgctcgcgaccgctcccgccttcaggaccctggagagcggccgccgcgcccctgggacccacgcccaacccagaacacccgcgctcgcctcccgcgcctcaccaccccagcactttattcgctgcttcccgcctccaccttcattttttttggcaaccaccgctcttgtttttcacagacagattaaattgttttttgtttggcatgagggggtgtttggattggccgagctacattccggtttgtaactacactaaacgttagtgtaccaag

SEQ ID NO: 129440 - DNA, 3403 bp, Homo sapiens
  misc_feature 1..3403: note = chr8:54791767-54795170
  misc_feature 1..3403: note = Hyper
  source 1..3403: mol_type = genomic DNA
ggacaccacagtaaccgtatgctggttttgtttctctctccccaccccagtccttcccgcctgcacagctcccagactcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccggtgagtaccgtggtctccactacgccccacacccagcctccccaggacaccagcctctcccgattcttcctaaccccaactgacccgctccgctggggctagcagtagggagggtggcaaggtcgggaaggccgggacgtggctgggcaagtcctaggacgggacattggcggctcccgggacaccgcccctccccgcgggaagacactccaagctactttttcctgggccatttcctttccatggtccaagaaaacgggagggagccctcgctcttccccgaggctgcctttcaaactctcagcgtgtcgctctcctccgcctactccgagcctcccccaaacgcgcctccgcctgctcccagcgctcgctctcccactcccctgccctctcggcaggcaagggaggaaatgacgtgatgttatttttgtgtcaggtcagtttccagcttcagcttagccctccgggctccagggaactaaccccgcggccccaccgggtcccactcccgaagggacgctgcgggctacggggacacgcggtgctgcgagtccggagagctgggcggctgggttccccctcccgctgccccctggtctactcctttccccggactccggagtccctggagaaggggacgcggagggcgactgccgagggtctcagcgggatctggagtcaggggttagttcccccccttatcccccgctcggttgctgggtggggcctccgcgctctggctagctgggagggggcgagggccgctttccagggcgggaagaccggaggcctaggctgcgccggggtggggcggggacagagctcagagaggcgccccgggccggggagaaggtagggggctgccctccagagacgcgcagtccacagacgcgaagctctggggaccaagcgccccctccatgcctgccgcccacccccgctccttcctcccgctcccttcattcacgaggtccgagcacgcagtccagcacactctagtctcgctcggccccgcgcgccgaggggaggcgatgacacagagggcttcgcggacgccctctacgcgcgcctggcttcgcatccacactcttgggacttgctaatgcggggctggagcagtggggctgcggccggggtggaggtcgcgccccgcgtggggcctcgggggtacccctagcacccgcggcggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcgtgagtatcccagttcctcgaactctctttcttcgtctcgggctcgccctgaggcttcgtgctggaaagtggccgaggctgggaggggcgcgccgctcgtccggacctcagggtgtcgccgttgctgcggggcgggagccggtgcgagtcgggggttccttcccgcagtgcgagtttgggggagtggggctgcgagtgcgtccgcgtgcgaagaggggcatcgcgccaccaggatcaatatgtcccgggcctgccagggcgtccgcgattccacctctgcggcttcgcgtcggtgtcttggtggggaacgcgggagtctagtctttagaccctagaaatcgcattgaccacccgaagcgtatttcggaaagaccaggcgggtggaagcgtcggctttctcacgggatagggagaggacaaggaaggggttgggcgcccggggctggtggtttgagcgccgctgggaagggtaaggagacagagcctcctggaatcgtagcgcctccttttaggagaagtgcaaccagggcaggggcaccgaggggcagggtgaggaagtggacgccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgttttggggaaaggtttgcgtgcgctgcggccctaccgctgctagagaagtggaagagagagagtgggcgccgggagggggtctataggcgccgcgacctaccccatctccctccacgcttgtgggggagtgagtggggaaggggctttgggagaggcggcgcgcgggcactgaggtgcatcgtgagcttcccggacttgacagcatcaaaggaaaatcctggcgagcagccagggccagcgagcgaccccagcagcagggacgcggccgtgcgagagctcgcggacaggcgagggggatcccaggggagcagctgctgcccacgggccacgggcgatgcacggagtggagaagtgaacgtggtctacaggatttctgtccggaaggtggagagcgctacaggggaatctcctcgattcctgtccgtctcgtaacttggcaaaagctcgcgccactgccc

SEQ ID NO: 129441 - DNA, 207 bp, Homo sapiens; identical to SEQ ID NO: 99536
  misc_feature 1..207: note = chr8:55122423-55122630
  misc_feature 1..207: note = Hypo
  source 1..207: mol_type = genomic DNA

SEQ ID NO: 129442 - DNA, 40 bp, Homo sapiens; identical to SEQ ID NO: 41788
  misc_feature 1..40: note = chr8:55191496-55191536
  misc_feature 1..40: note = Hypo
  source 1..40: mol_type = genomic DNA

SEQ ID NO: 129443 - DNA, 30 bp, Homo sapiens; identical to SEQ ID NO: 41789
  misc_feature 1..30: note = chr8:55285908-55285938
  misc_feature 1..30: note = Hypo
  source 1..30: mol_type = genomic DNA

SEQ ID NO: 129444 - DNA, 1547 bp, Homo sapiens
  misc_feature 1..1547: note = chr8:55366094-55367641
  misc_feature 1..1547: note = Hyper
  source 1..1547: mol_type = genomic DNA
ccacacacctcaacccggggccacagttggaggtggggagatctaagaaacactccacggatgagtttctgaagagggaagtggaccgggaacagcgcatttcctgcttcgcctgtgcaaatcccaggcggggccaagcgggaacggggacacggtctaagagtcgcccgctgccagggaggggttggggggcagcctcgaggggacaccgcggaaccagggagggatgcgcatggagggagtgggagaaggcgtccaagtaaaatgcatgctccggtcatcgggggtaacgcgcgtccccaaatcccctctcgctgtcgccctttttttcagtcctcacggggagaggccggcgcagcagtggagcaccgcaggggctggatcggacccgcactgcagcatctgcagggctccgacctggtgcgggcctccaaggcagggggcgcgcggcggcacagccggtggccgcgattttccgggccactccttccccccttacactcccctcccgcccgcgaccttcgacctccatcctggacccacggggtactggcccggggacaaggaggagacgttaaaggtatcaaggggcgcggcaccgccgcctagacggcgccgggacgcgaggtgcgaatcggcggcgtccggctgcgctgccctacctgggaggtgcgggaccctcggccgcgctccaccgccgcgcgccacctcgtgctggcctccgggaggcagccgcccgcgcacgatttataaatgcaaaggccttattgttgttctttgttcagggataccattgtctagtcatccacgggcagcctggagttttcccagggtttgcggcgcgcactcccctcccccgcccccacagacttgctctccagcgccaacccggatctgcctaggtgcccacgggtccttcccgatcgacttgagtgtccttcctccagcccctgctttcccagcatcgaaaacacaaaagcctgccggaaatcacccagcctttgcctggtcactcaggggcccacggataagcgtggctctgattcctccaggtcagccccacggttcgccacctacccgagttaatttctgcgcccgctgaccaaaggccccaactggcaacgggcacagcttcttggtgcgctagtcgcttccttgcccagcctttagagcctcgggtccggcccaaggacccggggacgtgagcgcaattagtagccaggagccctgcgaccctggaccgtgcagtgctaacgcacccgaacggctatgcgagcggtgtactcggctcttacttgtgaaagttgtttcccccaaccccctgcgtaaatctcttgtgttgagaaaagcaaggcttgcaggaagccactccggatgtttgctgctttacatgtggcatctgtggctggctctgataacgtcccggggcaccacgtattaaagtgaagagactgaaatagaaggctccacacaccgcgcgcgggtcagcgacgtcgccgccctccacactgccccccgaaatataagacaagcgaatgatcagaaga

SEQ ID NO: 129445 - DNA, 2450 bp, Homo sapiens
  misc_feature 1..2450: note = chr8:55370113-55372563
  misc_feature 1..2450: note = Hyper
  source 1..2450: mol_type = genomic DNA
ccactgaaacaccctcggcttctgcaaaaagatgtgctttaaagagaatagaatggacgctcggtatgttcatctaaacgaccttgggcaagtacgtcgattccaaggtacaatcagccctcccagacggcttttcgagtctccctaaccccggtgggagaggacgcggcgccagagcccagctccggctagttttcccgggggcaggtgtagccttgggcgcggggccgggggaggggcaaggggcgggcgtggggttggactgggacgtgggactcggaccacggcctgggcgtgggcctaacgacgcgggaccggcccgccctcgccgctccattggccacatctgtgcagaaaaggccccgcggcccaggggcgcccgcagtgtcactaggccggctgggggccctgggtacgctgtagaccagaccgcgacaggccagaacacgggcggcggcttcgggccgggagacccgcgcagccctcggggcatctcagtgcctcactccccaccccctcccccgggtcgggggaggcggcgcgtccggcggagggttgaggggagcggggcaggcctggagcgccatgagcagcccggatgcgggatacgccagtgacgaccagagccagacccagagcgcgctgcccgcggtgatggccgggctgggcccctgcccctgggccgagtcgctgagccccatcggggacatgaaggtgaagggcgaggcgccggcgaacagcggagcaccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggtgagtccgagtcgcagacccaggcggccgggcgcgctggcgcgaatcgctaggccgatttcttaaaccccaaactgttctttgcgagcctgacgcccaaaaccaggggtgtgtagcggccacgtcctttcttaaggctctgggttcccttcccgcttcccgccctccgaccctccaaagcagctttccgccttgctctccggctcccggattccccaggtggccgggggcgcgggtccaacggctctgggaaggcgacttcccggcacctccgggcggcgcgagagcacccttggccctgaactgggccggttgtgtccatccctcgaccccttccctagttaggtgtccttttctgtttttcgaacgaccgggtgatgggtgagcggaaagccgcttccaggagaccaaaagaaaggggtgcctttagaggacgggtgttccccaagggctcggactcaggagtcccagatctccctctttaacttcaccccggttgcgcaattcaaagtctgaggggggaggtgcgtccaggtggggccaggtggggcctggagcgggagcgcagccgataagccctgcgcccctctcccccttccttccactgtgcaggcaagtcgtggaaggcgctgacgctggcggagaagcggcccttcgtggaggaggcagagcggctgcgcgtgcagcacatgcaggaccaccccaactacaagtaccggccgcggcggcgcaagcaggtgaagcggctgaagcgggtggagggcggcttcctgcacggcctggctgagccgcaggcggccgcgctgggccccgagggcggccgcgtggccatggacggcctgggcctccagttccccgagcagggcttccccgccggcccgccgctgctgcctccgcacatgggcggccactaccgcgactgccagagtctgggcgcgcctccgctcgacggctacccgttgcccacgcccgacacgtccccgctggacggcgtggaccccgacccggctttcttcgccgccccgatgcccggggactgcccggcggccggcacctacagctacgcgcaggtctcggactacgctggccccccggagcctcccgccggtcccatgcacccccgactcggcccagagcccgcgggtccctcgattccgggcctcctggcgccacccagcgcccttcacgtgtactacggcgcgatgggctcgcccggggcgggcggcgggcgcggcttccagatgcagccgcaacaccagcaccagcaccagcaccagcaccaccccccgggccccggacagccgtcgccccctccggaggcactgccctgccgggacggcacggaccccagtcagcccgccgagctcctcggggaggtggaccgcacggaatttgaacagtatctgcacttcgtgtgcaagcctgagatgggcctcccctaccaggggcatgactccggtgtgaatctccccgacagccacggggccatttcctcggtggtgtccgacgccagctccgcggtatattactgcaactatcctgacgtgtgacaggtccc

SEQ ID NO: 129446 - DNA, 1075 bp, Homo sapiens
  misc_feature 1..1075: note = chr8:55379164-55380239
  misc_feature 1..1075: note = Hyper
  source 1..1075: mol_type = genomic DNA
gaccgcgacgtcgcgcgcccgcttcgaggagttttgagctcttagcttggtgccggggcccgcccggcgctagatgaagtgctcgtttactcggcctaagccacggtgactcgaaggtgagaatgcaacttcgcggtgcaccggctcaggggcctgcctgccgcgccaaggcttcggaagttctcagcgggaccgctgggacaggctttcctctgagggaagaggaggggatttgtgcctctgcacgttctttcctgtggaggggaaaatcaaaccctgtagccgtccgctgccgggtagggatcgggcgatgctcggcgcccgagttctccgccgttgaggtggagcccggcggcgggagcttagattctctgtgggccacatggtctcagaagaggccccgcggcccgggggcgcccgcagtgtcgctggaccggcggcagcgctggccacgccgtgggctgggactggcccggaacgcgggtggcggttcggcctcggagacccgcgcagccgtcggagcatctccgtgcctcgctcaccaccttcttttcctccgcgtccggcggagggtttcggcgcgcggggcaggcctggagcgccgtgagcaggccggatgcgggatacgccagtgactaccagagccagacccggagcgcgctgccggcggtgacggctaggctgggcccctgtccttgggccgagttgccgagctccctcggggacttgaaggtgaagggcgaggcgccggccggggccgcgggccgagccaagggcgagtctcgcatccggcgccttccaggtggggcgaaggtcgagcgccagaggctggcgagggacccccgcccagcttgacgcccagctgcgcccgacgccgggggaggcggagcgcggggaacccgggcgccgggaaccccggacgtgggagggctgggcttctgcgcggggagacgccgggcttggcgaacatcctcaagaaccggtcggtggctctacctccgaaaactctttcgtgtttagcgattctcatatttagtgtttccctttagggagacttgaccggcaattgcagact

SEQ ID NO: 129447 - DNA, 572 bp, Homo sapiens
  misc_feature 1..572: note = chr8:55382665-55383237
  misc_feature 1..572: note = Hyper
  source 1..572: mol_type = genomic DNA
ccttcctccgggaggcggcgcagcgcggggatcttgcgggaccaggccagagaccaggaccgtcccccaaccgttcgcggccgcgtagccctgggcggcctgggcctgcccttccccgcgcagggctttccctcctgccggtcgctgccccgcacatggctctggtcgtactcccgctccactgccaccactgcccacgccctgcgtccccgtttgaccgcgtggagccggaccccgccttcctcgccccgcgctgccccaggcctgccccgcaccagcagctaagcgcaggtctctactgcaagcccgcagccccctcatcgctgggcctactggcgacccccggcgccatgcgcgtgaactgtgggcgacgggctcgcccttggcgggcggcgcgcgcggtttccagatgcagccgccgcgccggggcagctgacgccgcctccaaagacgcgccctgctggacggcgctgaccccacgcagccagcggagtctcctgggaacagcccaggcgccggtgccgacttcaacctctctgctcaggcctcttgagttgcgttaccagcttacc

SEQ ID NO: 129448 - DNA, 103 bp, Homo sapiens; identical to SEQ ID NO: 99556
  misc_feature 1..103: note = chr8:55394094-55394197
  misc_feature 1..103: note = Hypo
  source 1..103: mol_type = genomic DNA

SEQ ID NO: 129449 - DNA, 30 bp, Homo sapiens; identical to SEQ ID NO: 15120
  misc_feature 1..30: note = chr8:55689465-55689495
  misc_feature 1..30: note = Hypo
  source 1..30: mol_type = genomic DNA

SEQ ID NO: 129450 - DNA, 133 bp, Homo sapiens; identical to SEQ ID NO: 99558
  misc_feature 1..133: note = chr8:55787730-55787863
  misc_feature 1..133: note = Hypo
  source 1..133: mol_type = genomic DNA

SEQ ID NO: 129451 - DNA, 30 bp, Homo sapiens; identical to SEQ ID NO: 99559
  misc_feature 1..30: note = chr8:55987089-55987119
  misc_feature 1..30: note = Hypo
  source 1..30: mol_type = genomic DNA

SEQ ID NO: 129452 - DNA, 407 bp, Homo sapiens
  misc_feature 1..407: note = chr8:56013520-56013927
  misc_feature 1..407: note = Hyper
  source 1..407: mol_type = genomic DNA
ctccttgaatcactccgatcacagatttaatttttcgagtcatttctggagttgtgggaccacacagctagtttgcaatccctatagctttaagagaaggtatttctagttttggagtaaggagtaagggaggtggcgcctgctccgggctccgccactccccgcccgcgggccgggggtggggtggcactcggtttcccgcggctgccggccgcgccccgcgccgccgccaggggtgctgcgcttcccacctgccgcaggacgcctcgagggccggtgcggtgcccactgggctgccgctcctcccggctcagagctttccagccgccgagaacgtgcgagggaccccggcgtcgggcaggggcctgggccgcgaagggcgggagcgcctccgcacctgcctgagc

SEQ ID NO: 129453 - DNA, 1672 bp, Homo sapiens
  misc_feature 1..1672: note = chr8:56014127-56015799
  misc_feature 1..1672: note = Hyper
  source 1..1672: mol_type = genomic DNA
gcctccgagcccgggcgcccgagttacacccattctccccaccatcgtcggccagagccgcgctcccagcccttctccaggtgctggcggctccgaccggaatacaaagaggcctgctcctccctggcccttgctgccgccacacccgtccgtgcccactctccgccgtcctccgcgagggctgcacgcagggacccctcctctcagcgcgctcctccccctcccccagtgtcgctcaaatccacccagcgttccgaaatcccgggagtgggggccttcgactgtcaccctcaggcccccttggccgctcctcccggcccttgggacccgccagggcagtcccccaacccccgcccgccgctcctctcggtcccggcccctcctccgggtccctcctcctccctcgcccctcccgagccagggtgggagcgacggcagctggaagagaagggatgaggtcatcctctccctcggagtcagctggtggaggagaggaagcgggaggagggagcgcgcgcgaggggaggagaggaatgtgcaggtccgaggagcgccgcggcggccgctgctgctcctgctgctggcggcggcggcggctcgggcggcagcagcgaagccgggacggcgaggagcgcgggcggcgggcaggggcgcgcgcggggcgccgcgagcagcttggctccgcgcaggcagccaggcggcgctcctgccggccccaggcgcgccgctagcccggcccagcgcccagcccggcgggcggcgggcggcggcggacggcaggcgagccgacgcaggagcaggaggagggggagccgcaccgcctgggagggaagccggggcgaggcgaggaggtggcgggaggaggagacagcggggaaaggtgtcagataaaggagggctctcctccggtgtggaggcatcatggccgctaaatcagacgggaggctgaaaatgaagaaaagcagcgacgtggcgttcaccccgctgcagaactcggaccactcgggctcggtgcagggattggctccaggcttgccgtcggggtcgggagccgaggacgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggagcagcggcgctactcactgtgggactgcctctggatcctggccgccgtggccgtgtacttcgcggacgtgggcacagacgtctggctcgccgtggactactacctgcgcggccagcgctggtggttcgggctcacgctcttcttcgtggtgctcggctctctgtcggtgcaagtgttcagcttccgctggtttgtgcacgatttcagcaccgaggacagcgccacggccgctgctgcctccagctgcccgcagcctggagccgattgcaagacggtggtcggcggtgggtctgcagccggggaaggcgaggctcgtccttccacgccgcaaaggcaagcatctaacgccagcaagagcaacatcgccgcggccaacagcggcagcaacagcagcggggctacccgggccagtggcaagcacaggtctgcgtcctgctccttct

SEQ ID NO: 129454 - DNA, 234 bp, Homo sapiens; identical to SEQ ID NO: 99566
  misc_feature 1..234: note = chr8:56361841-56362075
  misc_feature 1..234: note = Hypo
  source 1..234: mol_type = genomic DNA

SEQ ID NO: 129455 - DNA, 96 bp, Homo sapiens; identical to SEQ ID NO: 99567
  misc_feature 1..96: note = chr8:56364237-56364333
  misc_feature 1..96: note = Hypo
  source 1..96: mol_type = genomic DNA

SEQ ID NO: 129456 - DNA, 174 bp, Homo sapiens; identical to SEQ ID NO: 99568
  misc_feature 1..174: note = chr8:56364850-56365024
  misc_feature 1..174: note = Hypo
  source 1..174: mol_type = genomic DNA

SEQ ID NO: 129457 - DNA, 30 bp, Homo sapiens; identical to SEQ ID NO: 99569
  misc_feature 1..30: note = chr8:56367284-56367314
  misc_feature 1..30: note = Hypo
  source 1..30: mol_type = genomic DNA

SEQ ID NO: 129458 - DNA, 30 bp, Homo sapiens; identical to SEQ ID NO: 99570
  misc_feature 1..30: note = chr8:56367761-56367791
  misc_feature 1..30: note = Hypo
  source 1..30: mol_type = genomic DNA

SEQ ID NO: 129459 - DNA, 95 bp, Homo sapiens; identical to SEQ ID NO: 41794
  misc_feature 1..95: note = chr8:56539998-56540093
  misc_feature 1..95: note = Hypo
  source 1..95: mol_type = genomic DNA

SEQ ID NO: 129460 - DNA, 62 bp, Homo sapiens; identical to SEQ ID NO: 99572
  misc_feature 1..62: note = chr8:56602218-56602280
  misc_feature 1..62: note = Hypo
  source 1..62: mol_type = genomic DNA

SEQ ID NO: 129461 - DNA, 22 bp, Homo sapiens
  misc_feature 1..22: note = chr8:56613576-56613598
  misc_feature 1..22: note = Hypo
  source 1..22: mol_type = genomic DNA
gccgcggtggcttcacgcctgt

SEQ ID NO: 129462 - DNA, 80 bp, Homo sapiens; identical to SEQ ID NO: 99575
  misc_feature 1..80: note = chr8:56688545-56688625
  misc_feature 1..80: note = Hypo
  source 1..80: mol_type = genomic DNA

SEQ ID NO: 129463 - DNA, 41 bp, Homo sapiens; identical to SEQ ID NO: 99576
  misc_feature 1..41: note = chr8:56792024-56792065
  misc_feature 1..41: note = Hyper
  source 1..41: mol_type = genomic DNA

SEQ ID NO: 129464 - DNA, 30 bp, Homo sapiens; identical to SEQ ID NO: 41796
  misc_feature 1..30: note = chr8:56883198-56883228
  misc_feature 1..30: note = Hypo
  source 1..30: mol_type = genomic DNA

SEQ ID NO: 129465 - DNA, 109 bp, Homo sapiens; identical to SEQ ID NO: 99578
  misc_feature 1..109: note = chr8:56929738-56929847
  misc_feature 1..109: note = Hypo
  source 1..109: mol_type = genomic DNA

SEQ ID NO: 129466 - DNA, 965 bp, Homo sapiens
  misc_feature 1..965: note = chr8:57025591-57026556
  misc_feature 1..965: note = Hyper
  source 1..965: mol_type = genomic DNA
atgacgtccccaaggcgctgcccggggagcgagtcctcgaagacggcagcggagagggacgggcgcaggtcgtaggccaccaccgcgtacagtatgtgctgccgctcccccgaatacggcgcctgcttggtagtcatttgccagagagtgatggcaaaggaataaatgtcggctttaggcgtcacgccctctcctttcaggagctccggggcgcggtgggtgtatgtgcctcctagagggtaagagggtgtctggaagcacagcagatcttccaacttctcagagcaaccgaagtcactaattttacagacatcctgctcactgatcaagatgttcgcgggcttcaggtccaagtgcacaatgctttgcgagtggaggaagagcaggccgttcacaacatctagtgagtacttgagacactttcccaaacttaactgtcctccagtgcggcagtgaggctcccctgcgtccccctcagggtggccggcggcgccatagatgacttggtgtaaagtgacgttgccaccgaactccatgatgatggtccctaggctattggaccctgcgggcgtgcgcgtgctggcagccaccacgcgcacgatgttatcgtggcgcagccttgctacgttgagctcagcccagaaactccgccgagatgctagtcggttcttggtgcacttgttcacttgctttatggccacaggaacaccgcggtaagtcgccttgtacaccgagccaaaccctccagctcccagcctctgcagcaagcacacctgctcccagtcaatggagcaccaggccagccggcgcggcagccgcggggcccgaggaagagtggcccccagaagcagcttcgcaggtagctctgagggactgctgcagggccgcgcgtccaccgatggggaaaactcgctccggaggtaggggcgtagggccaggggcgagggcatcgcactttgcagggg

SEQ ID NO: 129467 - DNA, 678 bp, Homo sapiens
  misc_feature 1..678: note = chr8:57069553-57070231
  misc_feature 1..678: note = Hyper
  source 1..678: mol_type = genomic DNA
aaaaacctatgtggacgcatcaacagatgctgaaaaggcatttcctagaagtcggcagccaaacttggtaattcttgcgtgtgataaaggcagccgtctgttctgctcagaaggggtttcctaacaggaggggccgaatgcaggcgtcacatccacgccgccccaggtcgtacacctaggccgtccgggctgtcccagagccgcaggccccgcatcatccgcgtccttagcgcggggcgcggagcccgcagccaggtgcggccgagacccgcgcgccagggaaagcggcgcagcggacgcgggagaaggctggtgggtacaggttgcctccgggccggagcgcccatgcagggcgagctgcgctccgcacaaaattgcggtgggggcgccagaccgccttgctccgcccctgagcggggcgccccggcccaaccccctgagggaggagggtccaggtgccgcagactcttagcccctggcccggcgtccgcccggcaggttctggcactcctcgttggtaagccccgttatttcgtgcgcagtgtttacagaatataaagttcttcaggaaacgatgttataggagaaacgcctggattttccccaaactatcagagagtatcttaactatcaaaaaaaaaaaaaattcatttcagttaacgtcgggaatgagacacc

SEQ ID NO: 129468 - DNA, 30 bp, Homo sapiens; identical to SEQ ID NO: 99585
  misc_feature 1..30: note = chr8:57108924-57108954
  misc_feature 1..30: note = Hypo
  source 1..30: mol_type = genomic DNA

SEQ ID NO: 129469 - DNA, 359 bp, Homo sapiens; identical to SEQ ID NO: 99586
  misc_feature 1..359: note = chr8:57232533-57232892
  misc_feature 1..359: note = Hyper
  source 1..359: mol_type = genomic DNA

SEQ ID NO: 129470 - DNA, 1713 bp, Homo sapiens
  misc_feature 1..1713: note = chr8:57357954-57359667
  misc_feature 1..1713: note = Hyper
  source 1..1713: mol_type = genomic DNA
atgggaagatgactgcgtgtggaggggcccttagctgggatatgttaggagttgtggtgacagccatcttccttctgacagcccaggagagaacccagtgctatccgaggtgctgaacagaggacttctcggggttcccgaattcccagggttaaaacaaacttggtttgtgcggcgacaccgctacccttaccggtccccagatagtcgcggatccccgaagctaagagccagggcaggacttcagtcagtgttccaggaacagctgagacacccaggtcaccacgggctcgcgccgctgcggctccgacccggtgcgaaccgccatacgcgccgcgcggtgggccggaggcagtccgcgtactgttgcggaaactctgtctcacaaggtgcgcaacactcgccgcgcgcaacactcaccaggaagttgatgtcggccgggcgcactaggcggtagctgcacgtcgcgcaatcctggctgcattcggcccgcacggtcgccaggagcccggggccgagcaacagcagccaagtgcaaagtgtcaggaaccgcgccatggactgcgaggagagagggacgcgtgcttcgagcctgcctgggcgcagaacggggtccctcggcaggaccctcgccgcgacagcctcagcaggggatcgtcgagcaaaagcccgcaggaatgctcctttctggggccccgccctcccggccgacagcttttaggtagacgtggaggcgactcagatcgcctcgcggttcccgggatggcgcggtcgcccccaacgcgaggctgcctggggcacccggctcttttcctgggcgtccgcggcccagggcaagattccggagagaacgccgcagaccaggggcgagagagcgggagccgggggaggcaggacattgactggggtcacaaagaagaaccagggaacgctgttggggaacccatgcaatgaaatgtgaagggaaagagggcgggcagacgtccccaaacccgctcagcaaagacaagcttcgggcaaattcactcacgttgacgctgttcggatggagcaggccaattggaaaagccgggttcagacacgactctagagggaagagaagaaggcaagtgtgaggagggcgggcgtcggggagaagcgggcccgggtgtgctggcggacgtagggcctcaccgtcgcggtcctcagcgtctctgcggggtcacgggccaggctgcggggctctgagcgcctgcctcgccgtcccggggcttaacggctgctggagccactttataattagccccaaaccgaaggaggcgcgcgcgccccaatcgccggcgggctgcagctgacgcaggccctacgccagccccgcgccgacgccttcgcgggaggggtcggtcccccagcacccgcgcgccgctccccccgccgagctcgggtgggggccacagggggcgctcggtggctccccacacggccaggtgacaaacccaaggcagttaggaagtttggggagagtgagataggatcaagtttctccgcataaagtcactgaaattgcaccgtgggatgcgggctccagggagggaagcgaggtgggggcgtttggaaggatagatggactggcttagacttctggaatgtgctggagacccagcgggccggtgaacctgcccctttcccgcctcctccctgggccccctcgcgggtccccgtgggcaccaagca

SEQ ID NO: 129471 - DNA, 382 bp, Homo sapiens
  misc_feature 1..382: note = chr8:57360540-57360922
  misc_feature 1..382: note = Hyper
  source 1..382: mol_type = genomic DNA
tttccaggccctctgcgccctctgcaaagggctgatttctacagtcgctaggacctgcagcggcgctgctcccgcggggctccggccgcgctgcatgtcccattatagtcgctagagggcagcgctctcctgcgtaggctgggcttgcggggactggggtctcagttctccgcaggcctcaatgtgcgggcttgacacgcagccctcggattagccccgaagctgcacccgagcaccgcctgcctcccggccggggcatcacggtagcaaggtcgggaaagcagagccctggagtggggctggagaaccccggacatagccctagggagccagcattaccctctgagcaggaaaacacaatgtttcccgctttaggttcttt

SEQ ID NO: 129472 - DNA, 30 bp, Homo sapiens; identical to SEQ ID NO: 99593
  misc_feature 1..30: note = chr8:57427547-57427577
  misc_feature 1..30: note = Hypo
  source 1..30: mol_type = genomic DNA

SEQ ID NO: 129473 - DNA, 30 bp, Homo sapiens; identical to SEQ ID NO: 99594
  misc_feature 1..30: note = chr8:57565771-57565801
  misc_feature 1..30: note = Hypo
  source 1..30: mol_type = genomic DNA

SEQ ID NO: 129474 - DNA, 39 bp, Homo sapiens; identical to SEQ ID NO: 41798
  misc_feature 1..39: note = chr8:57566358-57566397
  misc_feature 1..39: note = Hypo
  source 1..39: mol_type = genomic DNA

SEQ ID NO: 129475 - DNA, 28 bp, Homo sapiens
  misc_feature 1..28: note = chr8:57696848-57696876
  misc_feature 1..28: note = Hypo
  source 1..28: mol_type = genomic DNA
ttctttctggccaggcgcggtggctcac

SEQ ID NO: 129476 - DNA, 120 bp, Homo sapiens; identical to SEQ ID NO: 99597
  misc_feature 1..120: note = chr8:57984827-57984947
  misc_feature 1..120: note = Hypo
  source 1..120: mol_type = genomic DNA

SEQ ID NO: 129477 - DNA, 30 bp, Homo sapiens; identical to SEQ ID NO: 41799
  misc_feature 1..30: note = chr8:57995953-57995983
  misc_feature 1..30: note = Hypo
  source 1..30: mol_type = genomic DNA

SEQ ID NO: 129478 - DNA, 20 bp, Homo sapiens
  misc_feature 1..20: note = chr8:58009302-58009322
  misc_feature 1..20: note = Hypo
  source 1..20: mol_type = genomic DNA
caccgcgcccggccgctcct

SEQ ID NO: 129479 - DNA, 281 bp, Homo sapiens; identical to SEQ ID NO: 99600
  misc_feature 1..281: note = chr8:58105899-58106180
  misc_feature 1..281: note = Hypo
  source 1..281: mol_type = genomic DNA

SEQ ID NO: 129480 - DNA, 113 bp, Homo sapiens; identical to SEQ ID NO: 99601
  misc_feature 1..113: note = chr8:58106596-58106709
  misc_feature 1..113: note = Hypo
  source 1..113: mol_type = genomic DNA

SEQ ID NO: 129481 - DNA, 129 bp, Homo sapiens; identical to SEQ ID NO: 41802
  misc_feature 1..129: note = chr8:58116950-58117079
  misc_feature 1..129: note = Hypo
  source 1..129: mol_type = genomic DNA

SEQ ID NO: 129482 - DNA, 165 bp, Homo sapiens; identical to SEQ ID NO: 99603
  misc_feature 1..165: note = chr8:58127855-58128020
  misc_feature 1..165: note = Hypo
  source 1..165: mol_type = genomic DNA

SEQ ID NO: 129483 - DNA, 527 bp, Homo sapiens; identical to SEQ ID NO: 99604
  misc_feature 1..527: note = chr8:58130301-58130828
  misc_feature 1..527: note = Hypo
  source 1..527: mol_type = genomic DNA

SEQ ID NO: 129484 - DNA, 30 bp, Homo sapiens; identical to SEQ ID NO: 99605
  misc_feature 1..30: note = chr8:58132758-58132788
  misc_feature 1..30: note = Hypo
  source 1..30: mol_type = genomic DNA

SEQ ID NO: 129485 - DNA, 288 bp, Homo sapiens; identical to SEQ ID NO: 99606
  misc_feature 1..288: note = chr8:58171442-58171730
  misc_feature 1..288: note = Hypo
  source 1..288: mol_type = genomic DNA

SEQ ID NO: 129486 - DNA, 32 bp, Homo sapiens; identical to SEQ ID NO: 99607
  misc_feature 1..32: note = chr8:58172070-58172102
  misc_feature 1..32: note = Hypo
  source 1..32: mol_type = genomic DNA

SEQ ID NO: 129487 - DNA, 30 bp, Homo sapiens; identical to SEQ ID NO: 99608
  misc_feature 1..30: note = chr8:58174512-58174542
  misc_feature 1..30: note = Hypo
  source 1..30: mol_type = genomic DNA

SEQ ID NO: 129488 - DNA, 30 bp, Homo sapiens; identical to SEQ ID NO: 99609
  misc_feature 1..30: note = chr8:58245377-58245407
  misc_feature 1..30: note = Hypo
  source 1..30: mol_type = genomic DNA

SEQ ID NO: 129489 - DNA, 27 bp, Homo sapiens
  misc_feature 1..27: note = chr8:58276371-58276398
  misc_feature 1..27: note = Hypo
  source 1..27: mol_type = genomic DNA
ggcgtgagccaccgcacctggctcaat

SEQ ID NO: 129490 - DNA, 38 bp, Homo sapiens; identical to SEQ ID NO: 41804
  misc_feature 1..38: note = chr8:58716351-58716389
  misc_feature 1..38: note = Hypo
  source 1..38: mol_type = genomic DNA

SEQ ID NO: 129491 - DNA, 989 bp, Homo sapiens
  misc_feature 1..989: note = chr8:58906952-58907941
  misc_feature 1..989: note = Hyper
  source 1..989: mol_type = genomic DNA
agaagggtggggacccggaaggtggggtgggggcgggatggaggcggggcggggtgtacgaggggcgtgtacactggctcagggacacgcgctctcggccacagcaactggctccaagttccctccctcactctccggcgaagcctgcctgagccctcccactcggtgcagaccgaaccatcgcggccgccgccagccgggcccttcgcggccgcgcgtcctgggcccgttccgccagccccgtctgctctctacccgcggccccgcggcggcgaccgtgaacactcggcggcccctacagcccgctctcggcccttcgtccctcgcgggccccgactctccctccttgcagtcccccggagcctggctcccggctcgggccgcaccgccagggactggggtgagcggcccaggtaagactgggccgtgggggccgggagagagactgctgggcgggggttgggattcgggttcagtggtcgcgccgcgccccgactgcggacaatgcgggagctgcgcgcggccaggcggcgcggagctaagccggctctgcgcctgcagcttccccgcccggcccgggtctccgttgagcccggcctcactggcccaggcggaccccgtccggctttctgggctgccgggggaggcgcagcgccgctgcctgccccgcgccccctctgcgctcggcttggctgcacgtcccgggctcggctaggaggctgggcacggggccggggctggagccggggttggagccagggcggggggaagctggccgcgctgcggagcggaggtgggctccgaaagcgcgccgccggttgctgctggaggagtgggactacgaaggatggggactccgctcggccaccgctcctgaatggtctctaatctcggtgttaaatactttatgagagtatcaataccacctaatcctttgctgagaattactgctagaaatgtagattctgaggttccgaaagtttgttttt

SEQ ID NO: 129492 - DNA, 100 bp, Homo sapiens; identical to SEQ ID NO: 99616
  misc_feature 1..100: note = chr8:59059033-59059133
  misc_feature 1..100: note = Hypo
  source 1..100: mol_type = genomic DNA

SEQ ID NO: 129493 - DNA, 30 bp, Homo sapiens; identical to SEQ ID NO: 99621
  misc_feature 1..30: note = chr8:59747348-59747378
  misc_feature 1..30: note = Hypo
  source 1..30: mol_type = genomic DNA

SEQ ID NO: 129494 - DNA, 43 bp, Homo sapiens; identical to SEQ ID NO: 99622
  misc_feature 1..43: note = chr8:59960049-59960092
  misc_feature 1..43: note = Hypo
  source 1..43: mol_type = genomic DNA

SEQ ID NO: 129495 - DNA, 739 bp, Homo sapiens
  misc_feature 1..739: note = chr8:60030169-60030908
  misc_feature 1..739: note = Hyper
  source 1..739: mol_type = genomic DNA
gggctgagaaggcagcgcactaaatatctctgtatcaggtaaaaaagccgtttggtgatgactcgccaccaggcaaatgttgggagtcccaacgatttttcccgtggaatgcaccgagggtcgccatggatgtgcctgcaggggctgtgagtatcaggcagatttatcaccaagcgagagttgggcgtctaaaaggcccgcccagcgttttagagaactcaattctctctgccaacgttcatccaacgggactgcttagacacgtccaactagccctaggcgtgggcagtcgtgcccctgcgaccactctgggggaccggtccctgcgtgtcctccctctctgggatgagagagttcgagaagccgggagagtaaccccctccctcgtaccccctgactgtcctataggtggacccagccgaactccgcagcagcccaggccagcgccccacctccgggtcaccggcatgatccgcctctccccgggcccccgcggccctggcacccgaggtcagcgggccgtgggtacagctcagccgcggaccctgctccgcgagtgcgggagctttggacttgaacgcgacgtgctcgcccggctcccaacaaacttgcaatttccgcgcgcaccccttaaacaggaactgttccccaaaccttgacccagctaccccgctgtgctctggcccgcggacctgtgtccgaacccgggctcggctgccggaaccggtttgagaaaaca

SEQ ID NO: 129496 - DNA, 645 bp, Homo sapiens; identical to SEQ ID NO: 99625
  misc_feature 1..645: note = chr8:60031146-60031791
  misc_feature 1..645: note = Hyper
  source 1..645: mol_type = genomic DNA

SEQ ID NO: 129497 - DNA, 148 bp, Homo sapiens; identical to SEQ ID NO: 99626
  misc_feature 1..148: note = chr8:60032140-60032288
  misc_feature 1..148: note = Hyper
  source 1..148: mol_type = genomic DNA

SEQ ID NO: 129498 - DNA, 269 bp, Homo sapiens; identical to SEQ ID NO: 32016
  misc_feature 1..269: note = chr8:60032490-60032759
  misc_feature 1..269: note = Hyper
  source 1..269: mol_type = genomic DNA

SEQ ID NO: 129499 - DNA, 30 bp, Homo sapiens; identical to SEQ ID NO: 99628
  misc_feature 1..30: note = chr8:60250268-60250298
  misc_feature 1..30: note = Hypo
  source 1..30: mol_type = genomic DNA

SEQ ID NO: 129500 - DNA, 155 bp, Homo sapiens; identical to SEQ ID NO: 99629
  misc_feature 1..155: note = chr8:60265545-60265700
  misc_feature 1..155: note = Hypo
  source 1..155: mol_type = genomic DNA

SEQ ID NO: 129501 - DNA, 18 bp, Homo sapiens
  misc_feature 1..18: note = chr8:60270884-60270902
  misc_feature 1..18: note = Hypo
  source 1..18: mol_type = genomic DNA
ttcttttttttgagacgg

SEQ ID NO: 129502 - DNA, 30 bp, Homo sapiens; identical to SEQ ID NO: 99631
  misc_feature 1..30: note = chr8:60506155-60506185
  misc_feature 1..30: note = Hypo
  source 1..30: mol_type = genomic DNA

SEQ ID NO: 129503 - DNA, 562 bp, Homo sapiens
  misc_feature 1..562: note = chr8:61193203-61193765
  misc_feature 1..562: note = Hyper
  source 1..562: mol_type = genomic DNA
tctccaagccaaaaacgaattcttcacgctaacactgtcttcctcaggtgtttagtaaaatgtaccgctgctcttcttgactactcagaagacataaaaggtacagccacggcttggaggctagcccgccctccggaccgcagcaggtgcgaacgccagccctgcggaaggctcccgggtgagagcgcaggcggcggaagagcgcaggcggcgagcacgcctccctggagcgcctcccgcccgaaacgcaccaggggagtgggaaagtggcagagacccccgtgggaaagagggggcgtgggggtgctcggagcgcgcagcggcagcaggactcgagtcccgcgctcggcgagacactgacgccgccgcgggaccccggacaccccgactcgcggccacttaccttcctcgtagccccactccacaccctcctcttcttcctcctcatcctcttccttctcggggaaggcgacggtatcttcgatgaagctcaggtccgccatgggaaggccgcggggcccctcggcgctctcggcagcagtgcctgcgccttcgctgggcg

SEQ ID NO: 129504 - DNA, 193 bp, Homo sapiens
  misc_feature 1..193: note = chr8:61194057-61194250
  misc_feature 1..193: note = Hyper
  source 1..193: mol_type = genomic DNA
cgacagttagaatgcgcctcggggcgactagtcccaagtcacggaaacctcggcgcatccccgcccgcccttcccccggggtcgcccccgccgcctcctggcgcttcctcgctgcggcgactcctgcttggccgcccgagccttccttccagaagcccgcaagtctcccaaggtcactcgggacccctgtgtg

SEQ ID NO: 129505 - DNA, 30 bp, Homo sapiens; identical to SEQ ID NO: 99638
  misc_feature 1..30: note = chr8:61196626-61196656
  misc_feature 1..30: note = Hypo
  source 1..30: mol_type = genomic DNA

SEQ ID NO: 129506 - DNA, 17 bp, Homo sapiens
  misc_feature 1..17: note = chr8:61205300-61205317
  misc_feature 1..17: note = Hypo
  source 1..17: mol_type = genomic DNA
gccgacactgtcctaaa

SEQ ID NO: 129507 - DNA, 30 bp, Homo sapiens; identical to SEQ ID NO: 41806
  misc_feature 1..30: note = chr8:61272270-61272300
  misc_feature 1..30: note = Hypo
  source 1..30: mol_type = genomic DNA

SEQ ID NO: 129508 - DNA, 82 bp, Homo sapiens; identical to SEQ ID NO: 99641
  misc_feature 1..82: note = chr8:61288499-61288581
  misc_feature 1..82: note = Hypo
  source 1..82: mol_type = genomic DNA

SEQ ID NO: 129509 - DNA, 39 bp, Homo sapiens; identical to SEQ ID NO: 99642
  misc_feature 1..39: note = chr8:61325744-61325783
  misc_feature 1..39: note = Hypo
  source 1..39: mol_type = genomic DNA

SEQ ID NO: 129510 - DNA, 86 bp, Homo sapiens; identical to SEQ ID NO: 99643
  misc_feature 1..86: note = chr8:61573279-61573365
  misc_feature 1..86: note = Hyper
  source 1..86: mol_type = genomic DNA

SEQ ID NO: 129511 - DNA, 30 bp, Homo sapiens; identical to SEQ ID NO: 99644
  misc_feature 1..30: note = chr8:61627523-61627553
  misc_feature 1..30: note = Hypo
  source 1..30: mol_type = genomic DNA

SEQ ID NO: 129512 - DNA, 30 bp, Homo sapiens; identical to SEQ ID NO: 41807
  misc_feature 1..30: note = chr8:61777517-61777547
  misc_feature 1..30: note = Hypo
  source 1..30: mol_type = genomic DNA

SEQ ID NO: 129513 - DNA, 119 bp, Homo sapiens; identical to SEQ ID NO: 99646
  misc_feature 1..119: note = chr8:61789866-61789985
  misc_feature 1..119: note = Hypo
  source 1..119: mol_type = genomic DNA

SEQ ID NO: 129514 - DNA, 505 bp, Homo sapiens; identical to SEQ ID NO: 99647
  misc_feature 1..505: note = chr8:61822378-61822883
  misc_feature 1..505: note = Hyper
  source 1..505: mol_type = genomic DNA

SEQ ID NO: 129515 - DNA, 22 bp, Homo sapiens
  misc_feature 1..22: note = chr8:62186531-62186553
  misc_feature 1..22: note = Hypo
  source 1..22: mol_type = genomic DNA
tgtagaccggagctgttcctat

SEQ ID NO: 129516 - DNA, 482 bp, Homo sapiens; identical to SEQ ID NO: 99649
  misc_feature 1..482: note = chr8:62200502-62200984
  misc_feature 1..482: note = Hyper
  source 1..482: mol_type = genomic DNA

SEQ ID NO: 129517 - DNA, 30 bp, Homo sapiens; identical to SEQ ID NO: 99650
  misc_feature 1..30: note = chr8:62212751-62212781
  misc_feature 1..30: note = Hypo
  source 1..30: mol_type = genomic DNA

SEQ ID NO: 129518 - DNA, 108 bp, Homo sapiens; identical to SEQ ID NO: 99651
  misc_feature 1..108: note = chr8:62221730-62221838
  misc_feature 1..108: note = Hypo
  source 1..108: mol_type = genomic DNA

SEQ ID NO: 129519 - DNA, 49 bp, Homo sapiens; identical to SEQ ID NO: 99652
  misc_feature 1..49: note = chr8:63056935-63056984
  misc_feature 1..49: note = Hypo
  source 1..49: mol_type = genomic DNA

SEQ ID NO: 129520 - DNA, 1811 bp, Homo sapiens; identical to SEQ ID NO: 99653
  misc_feature 1..1811: note = chr8:63160266-63162077
  misc_feature 1..1811: note = Hyper
  source 1..1811: mol_type = genomic DNA

SEQ ID NO: 129521 - DNA, 233 bp, Homo sapiens; identical to SEQ ID NO: 99655
  misc_feature 1..233: note = chr8:63998335-63998568
  misc_feature 1..233: note = Hyper
  source 1..233: mol_type = genomic DNA

SEQ ID NO: 129522 - DNA, 24 bp, Homo sapiens
  misc_feature 1..24: note = chr8:64023520-64023544
  misc_feature 1..24: note = Hypo
  source 1..24: mol_type = genomic DNA
caccgcgcccggccttaagtgttt

SEQ ID NO: 129523 - DNA, 30 bp, Homo sapiens; identical to SEQ ID NO: 99657
  misc_feature 1..30: note = chr8:64039936-64039966
  misc_feature 1..30: note = Hypo
  source 1..30: mol_type = genomic DNA

SEQ ID NO: 129524 - DNA, 191 bp, Homo sapiens; identical to SEQ ID NO: 99658
  misc_feature 1..191: note = chr8:64224292-64224483
  misc_feature 1..191: note = Hypo
  source 1..191: mol_type = genomic DNA

SEQ ID NO: 129525 - DNA, 22 bp, Homo sapiens
  misc_feature 1..22: note = chr8:64511304-64511326
  misc_feature 1..22: note = Hypo
  source 1..22: mol_type = genomic DNA
aatagaacgaagaaaggaggac

SEQ ID NO: 129526 - DNA, 30 bp, Homo sapiens; identical to SEQ ID NO: 99662
  misc_feature 1..30: note = chr8:64557179-64557209
  misc_feature 1..30: note = Hypo
  source 1..30: mol_type = genomic DNA

SEQ ID NO: 129527 - DNA, 47 bp, Homo sapiens; identical to SEQ ID NO: 99663
  misc_feature 1..47: note = chr8:64617631-64617678
  misc_feature 1..47: note = Hypo
  source 1..47: mol_type = genomic DNA

SEQ ID NO: 129528 - DNA, 463 bp, Homo sapiens; identical to SEQ ID NO: 99666
  misc_feature 1..463: note = chr8:65281329-65281792
  misc_feature 1..463: note = Hyper
  source 1..463: mol_type = genomic DNA

SEQ ID NO: 129529 - DNA, 1543 bp, Homo sapiens
  misc_feature 1..1543: note = chr8:65281852-65283395
  misc_feature 1..1543: note = Hyper
  source 1..1543: mol_type = genomic DNA
ctgcctctagggagaaaggggaggggggaggggagaagaaaaaggaaagagcgcgtttcctcgccggggttaccggggtggcgcgggcttcgcggccgaggggctgccggcccggcccgcagctcctcgcggccggctgggaagtggcgggtccggctagtccgcgggcgggcggagcgcgccgtcgctgccagtgtccccctttaacattccttccccgagcctttccctgctcctccgctctccgagcccggggcggccccgcagacaccagcgcctctatcctgcgctccttggcgtacgcagccgggcgaggtcgcggcgggaatgggcgccgaggccctgcccgccagggccgcatctgcggcccgagacttacttctgctttgctttcctgcacctggcccggggcaggctttctagtttctgcctcggccagaggagccgacttccgcaggacgggcttggggcagggggtgccggtgggggcagcggggcgaggcgaggtcgcagggagacgaccaggcctgcttgggcctgggccgctccagccgcctcgcctcttcagggacctcgccccgggaccacccgagcggacccacagcttctgaggaaacagctgcctcgggcctaagggtctttgctttcccccaacgcatgcaagcgtgggtcgccagcccagcatgtctggcgtggaggccggaggagggtggggagctggcggtgccctatggccagacgagtaaaagtcggttagtgttttatgcgcctgggggaggcgaagggcgcgggcttgcggggcccgggctgcgagtattgggagggggcgcctcgtgaggccgtgcgaggccgccctccccggcaggcctcgtccacgcccttgtggcctcccagacccgctgcgctttggctaggcgtccctacgcgcctccaccttctccaggtgcacgcctgggcgcggagctaggctgagcccccagcgaggggcgtggggcgaggggcgaggggcgagggcgtgggcgccacgcaggccgcggagcctggtgggcggcgtgaagcgtgcactgcgcctgcctgcccggtcccagcctgccgcccagagctccccgaccaagccttgacagctctcggagcagcgagaagaagaagaggaggaaggacacaaagaggaggaggcggcggcgggcggcgaactgagggcagctcagggggaggaggactcattgtccggtccccccagtccaattgatatgctaatctcttttctgatgccacaacaaagaacacctttgcacttttaaaagacttttgtgccctggctacagaagtttattatccactaattagcaacaacttctggcaacgagttgggttacattttcataagttccaggcctgagcgacgaggtgcgcagggcaggaggaggtttgagagcagggcaaacccgaaacctggcgctagaaaggaatcacccgctcactttcctaggcatagggcgccaggcggggatcgaaagcgaaaagtgtccggaaaaaggttctt

SEQ ID NO: 129530 - DNA, 332 bp, Homo sapiens; identical to SEQ ID NO: 99669
  misc_feature 1..332: note = chr8:65283762-65284094
  misc_feature 1..332: note = Hyper
  source 1..332: mol_type = genomic DNA

SEQ ID NO: 129531 - DNA, 235 bp, Homo sapiens
  misc_feature 1..235: note = chr8:65284457-65284692
  misc_feature 1..235: note = Hyper
  source 1..235: mol_type = genomic DNA
tgttacattccctttcgatggaactaaatgcggttatctgcggtcctaacctctctcgcatcggagtgcaatgtttctgaacaagctctgttagaactggaaaatgggagggggtgagggagcccactgacgacttaacggaatcttactgaagaaaatacaaagataaccgagatattcatgatattacatctcatgatcttccagacaagcgtctctccggaacaagaaaata

SEQ ID NO: 129532 - DNA, 1072 bp, Homo sapiens
  misc_feature 1..1072: note = chr8:65286063-65287135
  misc_feature 1..1072: note = Hyper
  source 1..1072: mol_type = genomic DNA
ccaccgcacggactgcgacgcggattacccgagcgcacgccggctgtaagtaccatcctttcctgcggtagccgggctctgcgtccccggctgggctgggagtgttcgctttgtgaatcgggttgttgcttgtgttttggtgttttggttcacaggggcttcttcgaagcttacacttttcgcacgtgagcgggagaagcgtttcgccggttgtgggcgtgcagaacacgatcctggttgactttgatgcggtgacttggggtggcgggcggggggcggcgggaggcgcggagtcgaggagttcccgcgtcgcgagcatgcttgagagccgccggctcagctccgggctgtaaggttggttcctggcaatggatggaaatcaggtcacagagatccctaagcttgccaggctctcagacacgcttgggagacagaatggaattggaaggagggatctgaagaggagggaggggatccgtgttcccccaccccgggcctagaatggagccccggccagccgcgggccgggccccttggttttcaggacttattcttgccggggttggctcgcacgccagcatcgcgccttcggtgcgtcttttatctccatctcaaatatgggatcttcttgggacgaggactgaatgagggtgggagagagggtgtgtctcacggcgcccaggagggagaaattgtggttctgagaaggtattttttggcctcttgaaaatgtgcaagaattccgcgggcccaggctttctttgtgtggcgggcagcgccaagcgctttgtgcttcacaaggagaaaatggcgagtcctattgtgtttaggccattttcttccggtactaggattttcccaagttcgaaatacttcttgagaaagtagccttctcgtgcccaagaaagtgtgaatcgctgaggctcggccccatggcctggcgtgggtgctgacctcagtttaaaaccaagggcctgttttcttaccgttggggtacttgtatcaaagcacagatatgaccggtttgtgcggatcggtgtcctccaaagatcaacagcggctcttggggttt

SEQ ID NO: 129533 - DNA, 1302 bp, Homo sapiens; identical to SEQ ID NO: 99672
  misc_feature 1..1302: note = chr8:65289049-65290351
  misc_feature 1..1302: note = Hyper
  source 1..1302: mol_type = genomic DNA

SEQ ID NO: 129534 - DNA, 788 bp, Homo sapiens
  misc_feature 1..788: note = chr8:65290655-65291443
  misc_feature 1..788: note = Hyper
  source 1..788: mol_type = genomic DNA
tctctctcctttcctcggactctggagcgggagcgggcctttccctcgggtcgaccacgccgtaggggacgccgtgaaaagagccgtcgcgcccgctgcctcctgcccgctgcgcagagggctccgcccgtagaggtcaacttccctcacccttttctctctcctgcttgccctccctccgcccggcccaggcgcttccagccccagactgtggccactggctgaggagtgcgagtcggctgcgctgccctgagcctaatccctcttccgggcccagacccgaggtccgcgctcctgggcagtggggaagctttagtgagcaggcttttctctccgcagcaaacttgtagccagaccagatgggccgcccagctctctcgggactaggcaggtgcggatgagttaatttttccgcattacaaagaaagatgacccagcccgcccttggactctcttttcccaaaatctcccaaccaaacccgcggtaacgttatcaaaggacacagagcccaggcatatctgtgtgtttatcttacaggcacacacgcatggttttctcttttatatgctagatttcatccctgacagcagaaaatgattggcaatggttatgacggagaacatgcaatagcgtggtccttaaaaacctgccattccttacaagtgccttagaaaggattcagggcgaaccaactgggttaattgcattcagtaaaataacacgattacaaaattagatctgtaccagaggggtaattaacttggatccacgccgtcatttgaaaact

SEQ ID NO: 129535 - DNA, 268 bp, Homo sapiens; identical to SEQ ID NO: 99675
  misc_feature 1..268: note = chr8:65291758-65292026
  misc_feature 1..268: note = Hyper
  source 1..268: mol_type = genomic DNA

SEQ ID NO: 129536 - DNA, 615 bp, Homo sapiens
  misc_feature 1..615: note = chr8:65292261-65292876
  misc_feature 1..615: note = Hyper
  source 1..615: mol_type = genomic DNA
agaacacttgccgcccgcatttccccttgacttctccctttttcttcccaatctcgaggcgttcatgcctggctttaagacgccaagataactctcttgttttggcattgtcgcaatgtccaaatcggtcaaaggagtgggataaggtgaaaggaccaggtcagaaactttagaaggactcggtaaattaatttgtttggaagccagtgaggtggactatgttgaggtagcagttccgcaccacgactttggagccaaagaaaaacccaggccgaaaaagcgagccttgatgtctttgttctgccttggcctgcaggggttgggaacaaaggagaggagctaagaggatgcaccaaagtagccgcgccctccctgcctggcgctgtccgcggtgctgaccgtggcccttttctctctccgtaatcaaactggaaaagcaataggaccgtcccgtccctactcaaaagaagagtaggatattaggtaatttgaaaaataacatttaaaaagagaaaaaggtcacatacagcaaaacaatattttactgaaatcgttccctcaagctggttgctacccttgcctgacactttttggtcttcacgtaggaatgcacac

SEQ ID NO: 129537 - DNA, 215 bp, Homo sapiens
  misc_feature 1..215: note = chr8:65293161-65293376
  misc_feature 1..215: note = Hyper
  source 1..215: mol_type = genomic DNA
gcagcttgccaccttcggccaggccttgcagcccggcagccttagtagacgggtacagagggctgagctctgcagaccgctctgctgcgcaggagcctgctcggcgcatcccagccggcgggaggcactggagggccaggaggcctgaaacccgcactgcggaaaaaccgacctcagccacatcctcatagctcacgcgacggaaagaggcaggg

SEQ ID NO: 129538 - DNA, 17 bp, Homo sapiens
  misc_feature 1..17: note = chr8:65385219-65385236
  misc_feature 1..17: note = Hypo
  source 1..17: mol_type = genomic DNA
tccgtctcaaaaaaaaa

SEQ ID NO: 129539 - DNA, 152 bp, Homo sapiens; identical to SEQ ID NO: 32039
  misc_feature 1..152: note = chr8:65488217-65488369
  misc_feature 1..152: note = Hyper
  source 1..152: mol_type = genomic DNA

SEQ ID NO: 129540 - DNA, 425 bp, Homo sapiens
  misc_feature 1..425: note = chr8:65488704-65489129
  misc_feature 1..425: note = Hyper
  source 1..425: mol_type = genomic DNA
taatctctctgcctccgagtagatcccgcgctcccaaatccggcgggggcgcagtatggtgaaccccacacctagctccctcagctgcgtgggtttcaagctgacccaggcgccaccaggcagccccgagtgggcgagtcaagtgcaacttcaaggtcaatgtgcctctgactggggcctggagagctgccaagaatgctgggcttggagcgctggggtcgcgccccgctactgcgccttggaccccgcagtggagggcgctgagaccgcacccccctccccgggcagttttcaggagagggtccagctggggtctccgcggtggggtccagaaacgatattccgggttggattcttcctcggttggggaagcacagctggcggagaattcccacggctctcagtggattcgcttttccagagct

SEQ ID NO: 129541 - DNA, 159 bp, Homo sapiens
  misc_feature 1..159: note = chr8:65489468-65489627
  misc_feature 1..159: note = Hyper
  source 1..159: mol_type = genomic DNA
gcactaatttcaatgcggtgctgtctgctgaatattttaaactcctttcaaagcagtaggtgtattccctcccgcagtaacaaaacgatattcatctttacacaaggtgctctggcgtttataatttggtatccaacacccggccgagaatgttccctt

SEQ ID NO: 129542 - DNA, 317 bp, Homo sapiens; identical to SEQ ID NO: 99685
  misc_feature 1..317: note = chr8:65489865-65490182
  misc_feature 1..317: note = Hyper
  source 1..317: mol_type = genomic DNA

SEQ ID NO: 129543 - DNA, 30 bp, Homo sapiens; identical to SEQ ID NO: 32043
  misc_feature 1..30: note = chr8:65490463-65490493
  misc_feature 1..30: note = Hyper
  source 1..30: mol_type = genomic DNA

SEQ ID NO: 129544 - DNA, 30 bp, Homo sapiens; identical to SEQ ID NO: 99687
  misc_feature 1..30: note = chr8:65492377-65492407
  misc_feature 1..30: note = Hyper
  source 1..30: mol_type = genomic DNA

SEQ ID NO: 129545 - DNA, 1302 bp, Homo sapiens
  misc_feature 1..1302: note = chr8:65492667-65493969
  misc_feature 1..1302: note = Hyper
  source 1..1302: mol_type = genomic DNA
ccttgcaaacatatgcgctaagctgtgtatacagatggcaggcagaataatggagcaggcgccttttataaagctctagctgctgcctgtcttcagacctgggaaatgaaactattcagacttgcggccagatagcgcctgcgattgtttgttaccgttttaatcctattaattaaaacgttaacctgattgggtagaaagcgctgtcccaacaggcgagtcttcttcataataacctactcagagataatgatgtaaaagactcccccgtctgtggcggcggctgtttgatgggtccggaaatctcttgaaggtgaatccaagcaagataaacggtgcggagaggaggcgcggggctgggctcagagcggcggcggcggcggctccactccctccgcgcccaccctcccaccatgcggggccgcggcccatggtgagccccagcagccagcaccatcggctggagacgaagaagaagaagaagaggaggcggcgagcgcgggggaaggcgaaaaagaaaaagaaagaaggggagagggctcccggcagcaccaggaccgacgcgcgcaccagctccggagcccagctcgcgcgcgtctgtggggccgcctgactccggggccgaggcggcggcggcggcagcgggcgcggcggcccgggctgcgcgccggcgcgggaccatggagcgcgggatgcacctcggtgcagcggccgccggcgaggacgacctcttcctgcacaagagcctgagcgcctccacctccaagcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgccgccgcctggaggaggcggcggcggcagcgcgggaagtggcggcggcggcggcggcggggtgggtgtccccgggctgctagtaggttcagccggcgttgggggcgaccctagcctaagcagcctgccggccggggccgccctttgcctcaagtacggcgaaagcgcgagccggggctcggtggccgagagcagcggcggcgagcagagccccgacgacgacagcgacggtcgctgcgagctcgtgctgcgggccggagtagccgacccgcgggcctccccgggagcgggaggtggtggcgcgaaggcagccgagggctgctccaatgcccacctccacggcggcgccagcgtccccccggggggcctgggcggcggcggcggcgggggta

SEQ ID NO: 129546 - DNA, 282 bp, Homo sapiens
  misc_feature 1..282: note = chr8:65494029-65494311
  misc_feature 1..282: note = Hyper
  source 1..282: mol_type = genomic DNA
gcagcagcagcagcagcagcaagaaatccaaagagcaaaaggcgctgcggcttaacatcaatgcccgagagcgccggcggatgcacgacctgaacgacgcgctggacgagctgcgcgcggtgatcccctacgcgcacagcccctcggtgcgaaagctctccaagatcgccacgctgctgctcgccaagaactacatcctcatgcaggcgcaggccctggaggagatgcggcgcctagtcgcctacctcaaccagggccaggccatctcggctgcctccctgc

SEQ ID NO: 129547 - DNA, 85 bp, Homo sapiens; identical to SEQ ID NO: 99692
  misc_feature 1..85: note = chr8:65498465-65498550
  misc_feature 1..85: note = Hyper
  source 1..85: mol_type = genomic DNA

SEQ ID NO: 129548 - DNA, 204 bp, Homo sapiens; identical to SEQ ID NO: 99693
  misc_feature 1..204: note = chr8:65498610-65498814
  misc_feature 1..204: note = Hyper
  source 1..204: mol_type = genomic DNA

SEQ ID NO: 129549 - DNA, 45 bp, Homo sapiens; identical to SEQ ID NO: 99694
  misc_feature 1..45: note = chr8:65499022-65499067
  misc_feature 1..45: note = Hyper
  source 1..45: mol_type = genomic DNA

SEQ ID NO: 129550 - DNA, 357 bp, Homo sapiens; identical to SEQ ID NO: 99695
  misc_feature 1..357: note = chr8:65499733-65500090
  misc_feature 1..357: note = Hyper
  source 1..357: mol_type = genomic DNA

SEQ ID NO: 129551 - DNA, 50 bp, Homo sapiens; identical to SEQ ID NO: 99696
  misc_feature 1..50: note = chr8:65519445-65519495
  misc_feature 1..50: note = Hypo
  source 1..50: mol_type = genomic DNA

SEQ ID NO: 129552 - DNA, 30 bp, Homo sapiens; identical to SEQ ID NO: 99697
  misc_feature 1..30: note = chr8:65615338-65615368
  misc_feature 1..30: note = Hypo
  source 1..30: mol_type = genomic DNA

SEQ ID NO: 129553 - DNA, 433 bp, Homo sapiens
  misc_feature 1..433: note = chr8:65710950-65711383
  misc_feature 1..433: note = Hyper
  source 1..433: mol_type = genomic DNA
cctcgccatctgggtcgcgcgcggcccgcggggcccagggcgcatgcgtggcctggcggccgaggcgcttacctggtgcgccggacaagcaagcagagggccaggagcagcagggccgcggcgagggccaggcccgggaggcccaaccgctccagcgaaaagcggcccgtggccgcggacacttctcctgccatccggcgcgcgctaggccgcggtgggcagcccggggtctgcctgcgaacagcgcggtcggcgactctgcagcctgcggcggcttctctcggcggcgccccctagtccagggccggagaggctggcctgcccgcagcgcagacaggaatgtcaccgtggtctcccaggctgaatgacaaaagttcgtggactgccccctccccgcctatcctccacccacgcgtaccgccccgttccccca

SEQ ID NO: 129554 - DNA, 30 bp, Homo sapiens; identical to SEQ ID NO: 99701
  misc_feature 1..30: note = chr8:65738006-65738036
  misc_feature 1..30: note = Hypo
  source 1..30: mol_type = genomic DNA

SEQ ID NO: 129555 - DNA, 90 bp, Homo sapiens; identical to SEQ ID NO: 15127
  misc_feature 1..90: note = chr8:65749819-65749909
  misc_feature 1..90: note = Hypo
  source 1..90: mol_type = genomic DNA

SEQ ID NO: 129556 - DNA, 33 bp, Homo sapiens; identical to SEQ ID NO: 41815
  misc_feature 1..33: note = chr8:66055590-66055623
  misc_feature 1..33: note = Hypo
  source 1..33: mol_type = genomic DNA

SEQ ID NO: 129557 - DNA, 24 bp, Homo sapiens
  misc_feature 1..24: note = chr8:66216965-66216989
  misc_feature 1..24: note = Hypo
  source 1..24: mol_type = genomic DNA
gcgagactccgtctcaaaaacata

SEQ ID NO: 129558 - DNA, 29 bp, Homo sapiens
  misc_feature 1..29: note = chr8:66500568-66500597
  misc_feature 1..29: note = Hypo
  source 1..29: mol_type = genomic DNA
caacaggaaacctcacgctattttctttt

SEQ ID NO: 129559 - DNA, 23 bp, Homo sapiens
  misc_feature 1..23: note = chr8:66545046-66545069
  misc_feature 1..23: note = Hypo
  source 1..23: mol_type = genomic DNA
cgatactccgtctcaaaaaaaaa

SEQ ID NO: 129560 - DNA, 32 bp, Homo sapiens; identical to SEQ ID NO: 99708
  misc_feature 1..32: note = chr8:66548717-66548749
  misc_feature 1..32: note = Hypo
  source 1..32: mol_type = genomic DNA

SEQ ID NO: 129561 - DNA, 92 bp, Homo sapiens; identical to SEQ ID NO: 99709
  misc_feature 1..92: note = chr8:66560181-66560273
  misc_feature 1..92: note = Hypo
  source 1..92: mol_type = genomic DNA

SEQ ID NO: 129562 - DNA, 380 bp, Homo sapiens; identical to SEQ ID NO: 99713
  misc_feature 1..380: note = chr8:67024905-67025285
  misc_feature 1..380: note = Hyper
  source 1..380: mol_type = genomic DNA

SEQ ID NO: 129563 - DNA, 23 bp, Homo sapiens
  misc_feature 1..23: note = chr8:67028548-67028571
  misc_feature 1..23: note = Hypo
  source 1..23: mol_type = genomic DNA
agactagaaacaggtcggcatgg

SEQ ID NO: 129564 - DNA, 615 bp, Homo sapiens; identical to SEQ ID NO: 99715
  misc_feature 1..615: note = chr8:67089421-67090036
  misc_feature 1..615: note = Hyper
  source 1..615: mol_type = genomic DNA

SEQ ID NO: 129565 - DNA, 201 bp, Homo sapiens; identical to SEQ ID NO: 99716
  misc_feature 1..201: note = chr8:67117726-67117927
  misc_feature 1..201: note = Hypo
  source 1..201: mol_type = genomic DNA

SEQ ID NO: 129566 - DNA, 361 bp, Homo sapiens
  misc_feature 1..361: note = chr8:67344509-67344870
  misc_feature 1..361: note = Hyper
  source 1..361: mol_type = genomic DNA
agcagttaccttctacggcaatttcaagggtggatggtgcgagcgccgctggggcagctggcgttctggttcttactccgtgggaaaatggccctgagcccgactggcttgaggcttagacaggtgaccccgcgaagcgggtgggcaggcgcggccgaggggcgggaggcgggcagcctccgtgattggccggcggagggggcggtgtagcgacccgaggagggaagaggactccaagcgccatggccgctgccgcccgagcccgggtcgcgtacttgctgaggcaactgcaacgcgcagcgtgagtgcggggccggcgggcgggcaggggaccgcagggtgcccacgcagccccctgggt

SEQ ID NO: 129567 - DNA, 30 bp, Homo sapiens; identical to SEQ ID NO: 99720
  misc_feature 1..30: note = chr8:67345235-67345265
  misc_feature 1..30: note = Hyper
  source 1..30: mol_type = genomic DNA

SEQ ID NO: 129568 - DNA, 30 bp, Homo sapiens; identical to SEQ ID NO: 99721
  misc_feature 1..30: note = chr8:67371236-67371266
  misc_feature 1..30: note = Hypo
  source 1..30: mol_type = genomic DNA

SEQ ID NO: 129569 - DNA, 24 bp, Homo sapiens
  misc_feature 1..24: note = chr8:67580710-67580734
  misc_feature 1..24: note = Hypo
  source 1..24: mol_type = genomic DNA
gggcgcggtggctcacgcctgtag

SEQ ID NO: 129570 - DNA, 23 bp, Homo sapiens
  misc_feature 1..23: note = chr8:67580974-67580997
  misc_feature 1..23: note = Hypo
  source 1..23: mol_type = genomic DNA
caagactccgtctcaaaaaaaaa

SEQ ID NO: 129571 - DNA, 30 bp, Homo sapiens; identical to SEQ ID NO: 99724
  misc_feature 1..30: note = chr8:67638459-67638489
  misc_feature 1..30: note = Hypo
  source 1..30: mol_type = genomic DNA

SEQ ID NO: 129572 - DNA, 2370 bp, Homo sapiens
  misc_feature 1..2370: note = chr8:67873327-67875697
  misc_feature 1..2370: note = Hyper
  source 1..2370: mol_type = genomic DNA
ggcacaaaaatccttcggaggcatcctgtaagaggcttgcgagactcttaccaagccaccccggctttaaacgcctctccagccacctgtgaaccgcgaaggagccggctttcgcggcggggaccttgccaccagtaccctcgcgggccgaggtcgttctcccggtcggcttcccgcctcacccgaaaaggaattagagcatctacccaagacggtgactggcagggcagatcaaggtgtcctggtctcggccccagccccgcggtgcgccccgcccgcttaccttgaccgggtgcaggtagccatcgccgcgcagggcgcccaacccggcgtccgccggcgcctcggcgtcgtcctgcaggctgcgggtgagatgcgcgatgtaggtggtggccagcagcagcacgtccagcttggacagcttggtgtcgggcggcacggacggcagcgtgcgctgcagctccaggaaagcgtgccgcagggtctgcacccggctgcgctcccgcgccgcattcgccgccgccggccgcccgctcccggaacgcgagccgcccccagggcccgccggccccggcccggtccgcccgggacgcgagtcgcggatggcggcggccaggggcgcgggctcggcgctggcgctgagggggctgcccgctgggcggccgcggtccatggcagcttcccgcgccgcgcgcgctgcaaaggaccgaaggtgcggtgaggccggggggcggtcgggcttaacccgagaggcgcagccccctggttctccccgtgcgcccaccagcagcccaacggggctaagggcgctctcaagcgagctcgttttgcctgggacgcgatttgcttccggacgtctggggagagttgcggaactccggagttcttgggcttcctagaaggataagaagaggcgcagtgccggctttgcttttcaggggcaaattaagcaaaaggtctactctacccgggaagaaagatctcggaagcacagctcaggatcagcactcgttcgcgcttgggtgactttatccaacccggcacgcacgagaggtggcgcggctccttctcgccgacgccgcggaaaaccacggctcaccagccgccctcggcctttcacgccaggggggatttctgcccgaggagcgggggacccttagcctcacctcggggtacggcacccgccaccgttccgagcccgagagctgcgcagtacgcgtctgacgggcccctcacctttcctggagcggctgagtggagctccgctccgtcgtgagggcgggcgaggggcgtggagcagggcctgtgtggccagggccgcgctggtcactccatcctcgtccggccgatgcccaagtcgacggctgtttccaacctccgctggctgtgacttttatgcgggcgccccgcggccaggcgtgtgtgctccgaccggctaaggcaggtcgggcggaggacctggcccaccggagaggctacgccgggggctgaggcggcttagagggtcattaatcaaaccctccggcggggcgggctcgggggcggggcgtcctcctggccccgcccctcggctcactgcctcacgctgctttccccgaggcgcctcgctgagggcggcgtgtggagagtttggggtgtctgccgccggctgcggtggggccgggctggaggccgcgggtgaggcctgtggttaacctcgcgctgccgaggtcttacctcctcgagtccagtctgattccaggccgcttccaggccggtgcccagctgaggcgggaacgctgcagtttggttgagcgtgacttttaggctctgtgaggaaaagtcgagcgcgccacatcgaggcgctagccgtttattctaccacaaggtaaaagattcatgctgtcctagttaccctaaagctgggagatacactgcacttcctaccagaccccgaatgctctcagtgtctgtaattctttaagaagttcctagagcagacagcccttggatcgtgggcacttctccccggggacggggaccctgctgaccgcctccgctgcccccgcgggggccaccgctctttaattatttgggcgaaacattcttttctggttttgcacttgtggactcacgggaagcgtgacttgcagcgaggcaggacccgatcccaggcttctttagaaagcggacgctgcgccccaaggcctgttcagagccgccccaggaagccgtgggtccccgaccgccccaaaccgcagcggtttctgcaggtcctggacccgtcgccttcgtaggtgaaatctaagtacttttcagcaacataattagaacacactcgaaacaatgcctgcagttctccgagtaggacattttctgtttttgtgtttg

SEQ ID NO: 129573 - DNA, 386 bp, Homo sapiens; identical to SEQ ID NO: 99734
  misc_feature 1..386: note = chr8:67940624-67941010
  misc_feature 1..386: note = Hyper
  source 1..386: mol_type = genomic DNA

SEQ ID NO: 129574 - DNA, 30 bp, Homo sapiens; identical to SEQ ID NO: 99735
  misc_feature 1..30: note = chr8:68107540-68107570
  misc_feature 1..30: note = Hypo
  source 1..30: mol_type = genomic DNA

SEQ ID NO: 129575 - DNA, 105 bp, Homo sapiens; identical to SEQ ID NO: 99736
  misc_feature 1..105: note = chr8:68347722-68347827
  misc_feature 1..105: note = Hypo
  source 1..105: mol_type = genomic DNA

SEQ ID NO: 129576 - DNA, 29 bp, Homo sapiens
  misc_feature 1..29: note = chr8:68780039-68780068
  misc_feature 1..29: note = Hypo
  source 1..29: mol_type = genomic DNA
gtattcataaggatacgattttttttttt

SEQ ID NO: 129577 - DNA, 76 bp, Homo sapiens; identical to SEQ ID NO: 99743
  misc_feature 1..76: note = chr8:68864043-68864119
  misc_feature 1..76: note = Hyper
  source 1..76: mol_type = genomic DNA

SEQ ID NO: 129578 - DNA, 16 bp, Homo sapiens
  misc_feature 1..16: note = chr8:68864179-68864195
  misc_feature 1..16: note = Hyper
  source 1..16: mol_type = genomic DNA
gcgtgtgtgtgattag

SEQ ID NO: 129579 - DNA, 398 bp, Homo sapiens
  misc_feature 1..398: note = chr8:68864498-68864896
  misc_feature 1..398: note = Hyper
  source 1..398: mol_type = genomic DNA
tcttctgtctctcctcggagttggcggaggcggcaactttccattctcgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggtgagtgtccccggcagacgcagggggacgtccgggcggcgcggggcgcgggtcccggagtggctgcgggaaggacgcgcggcattgtctgtgcggggacccgggacgggtcggggcatcacaggc

SEQ ID NO: 129580 - DNA, 126 bp, Homo sapiens; identical to SEQ ID NO: 99746
  misc_feature 1..126: note = chr8:68865314-68865440
  misc_feature 1..126: note = Hyper
  source 1..126: mol_type = genomic DNA

SEQ ID NO: 129581 - DNA, 208 bp, Homo sapiens; identical to SEQ ID NO: 99748
  misc_feature 1..208: note = chr8:69242803-69243011
  misc_feature 1..208: note = Hyper
  source 1..208: mol_type = genomic DNA

SEQ ID NO: 129582 - DNA, 900 bp, Homo sapiens
  misc_feature 1..900: note = chr8:69243071-69243971
  misc_feature 1..900: note = Hyper
  source 1..900: mol_type = genomic DNA
ttcgagccccgcggcccctgtccgcccgcgtgcgcccctcgacacagctcgcctcccgccccctgattcctgctgctgccgcccagaggagaaaggaacctctgcctcgaatttccccactgcgccgggcgctgcggagagcggcgagggtgggcgcgaggcggagaacgcgatgaatgagttctcccctcgcctcggagttgtctgagttggcggcgctgcgcccaggcttccggctctcagcgccccacgcgcgcgtggctccccgggctgccacccacgcccgcggccggggccgagccagccacgcagggcagccgaggctccggagctcctgtcccggccccagtccgggtaaaaggagggttgtccccagcggaggcgcacagccgcgcgttctccctgcactctcttcgcggtcccatctgttccccatggcgtctcatccgcaaacccggatccaggcttacctggagaagaacaagatcggtcccctgtttgaggtaaggcgctgtggaggagggcagtcccgttgtctttaggggaaggggtgcagtaatgaaaacagaacactcccaatcccacccctcccagggaaggagggctagagaaccaacgcgcgggagagggcgccctgggattcactggcattcgctctgtcccggccaggtgtcctggaacgcggccgggcgggcacttagccagttacctgaacgcggacaggtgagctcgggagggcccagcctcagcctggcaggggaagttttggccctctgactgtcctgcacctctcagctacatgttcaggacccgggcaggctgaggcaggcgacgcatacggatgcacacactcagactgtgttgcacacgcacactttcttttttgaattcacgctatct

SEQ ID NO: 129583 - DNA, 748 bp, Homo sapiens
  misc_feature 1..748: note = chr8:69244031-69244779
  misc_feature 1..748: note = Hyper
  source 1..748: mol_type = genomic DNA
ttttttttttttttttaatgagggcggtaatagaacccgaaaaggtggaggaggtgcttagcagttaatacaattaactggaagacagctgaactggtgaggagtaggcttcagtcggtgcgggcgtgatgaatgaaattggcaaactgagagactgccatttggtcactggacgaaaggagagtcctttgcactgcagaccccacatgtgttagcaggagaaagggacggagaaaggttctgaaaagcacacacgtatttgtggaagaagactatagctctgagctggttttgtttttttttctctctctcgccattaaagaatttaagacaaaaatacagtagaaggaagagcgcgaggacacgagaaaatgagaacaagagattgaagcctggcaccagcaaagcgtcccgcgggttgccagggtgctgagcaggggtggggcgtgcggaccgtagtcagaagtggaggcccttgcggagggactcccttggtcccatccagttcagggggcactgaccggcggcgagagttcgcgggagggtcgaggtgctcccgccttgcccccgccttgcccccgccttgcccccgccccccacgtctcccagaagcagttgtagctgttcttaacagcttggtttggggtgagggcttggtatggggaggaggttacgtgtcagtgtctgagagaggcagaatcgcggcaagtggaaggggctgcactggagatcgcggaaaacctagcaa

SEQ ID NO: 129584 - DNA, 414 bp, Homo sapiens; identical to SEQ ID NO: 99757
  misc_feature 1..414: note = chr8:70404780-70405194
  misc_feature 1..414: note = Hyper
  source 1..414: mol_type = genomic DNA

SEQ ID NO: 129585 - DNA, 143 bp, Homo sapiens; identical to SEQ ID NO: 99758
  misc_feature 1..143: note = chr8:70412954-70413097
  misc_feature 1..143: note = Hypo
  source 1..143: mol_type = genomic DNA

SEQ ID NO: 129586 - DNA, 30 bp, Homo sapiens; identical to SEQ ID NO: 99759
  misc_feature 1..30: note = chr8:70571296-70571326
  misc_feature 1..30: note = Hypo
  source 1..30: mol_type = genomic DNA

SEQ ID NO: 129587 - DNA, 521 bp, Homo sapiens; identical to SEQ ID NO: 99760
  misc_feature 1..521: note = chr8:70744803-70745324
  misc_feature 1..521: note = Hyper
  source 1..521: mol_type = genomic DNA

SEQ ID NO: 129588 - DNA, 57 bp, Homo sapiens; identical to SEQ ID NO: 99761
  misc_feature 1..57: note = chr8:70785966-70786023
  misc_feature 1..57: note = Hypo
  source 1..57: mol_type = genomic DNA

SEQ ID NO: 129589 - DNA, 23 bp, Homo sapiens
  misc_feature 1..23: note = chr8:70842992-70843015
  misc_feature 1..23: note = Hypo
  source 1..23: mol_type = genomic DNA
aatactactcttggccgggcgca

SEQ ID NO: 129590 - DNA, 80 bp, Homo sapiens; identical to SEQ ID NO: 99763
  misc_feature 1..80: note = chr8:70847246-70847326
  misc_feature 1..80: note = Hypo
  source 1..80: mol_type = genomic DNA

SEQ ID NO: 129591 - DNA, 184 bp, Homo sapiens; identical to SEQ ID NO: 99764
  misc_feature 1..184: note = chr8:70945287-70945471
  misc_feature 1..184: note = Hyper
  source 1..184: mol_type = genomic DNA

SEQ ID NO: 129592 - DNA, 972 bp, Homo sapiens
  misc_feature 1..972: note = chr8:70946686-70947658
  misc_feature 1..972: note = Hyper
  source 1..972: mol_type = genomic DNA
tgaaaagagaaaacacgtagacataatctggatggcggagactgaagagtgattatctctaggtggctggatgctgggtataggttggccgcaatgttatttttgtaaggctaggagaaaaacgttattttaaatatacggaatttgctcctctccaaatccactctccctttcgcctccctagaggttgtcaggttcaagaagcggcccggagttgcaggaagggcgccggcgtcactggccccaagagctcggaacgcgcgcgccgcaggagtgccggctgcggggtcgggttgagactggcgggaccctcggcctctgccggggtgcggaaggtggatgctacgggcaaaggggcggggcttgcggttcccagatccagaggcgggttggggacgtgagccggcgtccatgtgttctgcaccccttctcgcccggtgcctctctcaaggcacgttttccaaagtgtgttgaattcgggaatcgatcgaaaatttcaaggccaattaaatgccctctgatgtagagctccgattaggcccgaaaggcttcaaacagcccctctagaccctcgagggtcttcgccgcggtaaccttaggcgtcccctccccgagaagtctccctgaggctttcacagagggcgggaggggctgcgctggggcctccgttcccagtgcccctgactggtggggagggatggccttagtgtctgagagcagagaccagattgactcccacttgagaccagaaaacgaagaggaagcggaacccgaggtggctgcggctcccccgggacacaaccgggagaggaagtcctggccatctgccggccccgcctgggggcatctgctcgaggatccctgggagccgttatcgtattcctcagaatctgccgtgctgtccctccgcccccaaaaccaacaggacacccattctgtgattctcttcttctccatcgcccagttggaggc

SEQ ID NO: 129593 - DNA, 3280 bp, Homo sapiens
  misc_feature 1..3280: note = chr8:70981714-70984994
  misc_feature 1..3280: note = Hyper
  source 1..3280: mol_type = genomic DNA
ttcactgctggcacccgcgtactcgtggctgctgctcaggaagggcggcacttccctggggacgtggggaattgggtaccacggtggcagcttgctgtaccagggcagatcgtagagaggctccctctgtaggcccagacccgggctcagcaagggaggcgccatccggaaggggaaggggggcatggcgggggcagcagacgctgcggcctccagctgccggaaaggttggaagtcttcctccacggtggccaggctgtttctgtagtgtccataggacgggaaaggcgtgtagtacgcggccaggttctgcgggctgctctccggcgggtagcacaccttgtcctgaggcacggcctcacttggccggggtagagccatcccgggaccgcacgctcggcggctctgcagaaaagcgggcgccgctgaggacaccgcgcgggagcttcccggggtccgacccgcgcctccccaccagcctcctccaccccagccagccccagatccaagggaacaggataaacgcccccagtccgatcccgccagcccgctcccacaattaagacaaaacgaaaaaacagcaatagaagcaaacacaaaaaagccccaaacggaaatctgccgggatcctgccctactctaaattccgggttagtgttgccttccccttccctctccaagcaccccttccctaagcccggccgccttcccacacccgctctccgctttcggcccccaacccggttcctgcaaaacccattgaagttccctttccttccttcttctcagtcctacaaaactcgttggtagggtctgtgggagccgcggggccctgccaacctcggggctgggccgggagccgagcgcaggcggtcggagggcaatggagcaagcgacagctccaggcgctcctgggccctcggctgggagggaagagccgaggaccctgggtcgcaccgcgcagatggagacgcgctcccagagcccccgggcaggtccagggaccccgcgacctgctctggcccagcggtgtgaccccgcgggtcctggcggtcctgactgcccgcaggggaggggcgcgccacttttggctgccctaggatgcgccgcctgaacctcttttccctcgcgggcagcgtccgccacattccccgggttcctcggaaactccaatcattctaccaggactattggggcctggggtagcccctcgggagccgcgtggacgagccctggccaggtgggagcgaagagcctcggcgactgccagtcctcccgcccccgcaccgccgggaaaggatggcgttttaatagacaggcagcaagttcaccgaggctgaagaatgaagccccttcagggccggcgggtcttgagatcaatgagcccaataagaaaaccaagcagggtcatgactcagaaattaaagaacacggggtcaggagaagaggtcagccacgacacaggcagcggcccgtctcctcccgatcctccaaaggcgcccttctcctagcctcctccgacctcagggatctgcaacttgggattcaaagcccccgagagggcagaacgaccatccaaaacgaactgcgccagcgagtgctgccgccctccccaacggccctggaagaccaccgccccgggccccaggcgcgtcctgtcccgtgcctacctccgacaccacctccaagagcgccaccgcggagcgggcgcctcctggacgctgcggggccactcgggctcggtaggccactcgggctcggtagacttcgggcgggccctgagggctgagccaggcttaagagggcgggcggggccgcggggcatcgacaggtcgagggtagggaattgacccggcccacgcagatccccgcgtcgtcttctccccgcccaccgcagccattggccgactctcgactcgccctctgtcccctggggtcgctcacttaactcatcagttttccaaaccctccctgggaccctagtggcgagcactcgccgctggccttctagggcaggcagtattgccgctccaggcgtgcggagtcggggagaaaaaaaccgaacacgtgtgctacccagggcccccagataagcccctccgcgcgcacacacaccctgaaccggagtccagaaggccggactcgcgtcccggggtcgagccccttactctccgctcccagttcggaagatcccagcctgcccgaaggcggcgtctgacccgctggtggacctggtgggtgtctgttcctgatacctggggacgaggcgggagcgccttgagcgctgggaagcttcgcctcgcgagtccccggcagtgacacgtgggagcgttgggcccggcacccccgacgcttccgaggtttcgggtggtcgttttgctctctcgggggcttttattccttaagtggctttaaacgaccgaggatgggcctcccgcgccgccgcagctgtcacttccttcgggaaaggctagcgaccttggacgcgcaggctctgaaaaccaaggtccagacccataccgagcgcccaaagaccgcatttgaattctcctcgccggccattgagggagagaaaggaacgcttagttccattcacattcacagaaagaagcgccgagggtgggggaaacgcagtcttgccgggtgagccgggacaggttcctcgcctgccccccggccgctgcttcctcttagctgaatggggagcgacccgccccgggcgcggccttcggggctgaagactgaggtgcagcctcacccccggcctggcagcggcttggaagagagagggaaaggaggaacatctacccggctaagagacgccgccagagtccctaaagctggcgggggacggaggccggggtcccggatcttcagagcgcccgcagccgggcttctgggctcctcggtgcggggaacctgaccctgtagccttcgccagggcgcggcggggctgcaagaagggaggaaggagtgggactagagccttcgagggcgcgggcggcgtgcactcagccttgtctccccgcgcgccctgccgcctgcttgccccctttgctgcaccgggtggccctggtccccgcgcccgcccgcccccgacgccttcgcgtggttccgcgctgcccgcggccagccccgtttcgcttcgcaaggagcgtgttgttttctcaatcgaaatgggatcaagatcccagggtttcctcgtctccttgttttgaggtgataggatcttagccaatagatcgaaaacgtgaaaagtacccgtcgcctcttgtcccaa

SEQ ID NO: 129594 - DNA, 240 bp, Homo sapiens; identical to SEQ ID NO: 99774
  misc_feature 1..240: note = chr8:71017239-71017479
  misc_feature 1..240: note = Hypo
  source 1..240: mol_type = genomic DNA

SEQ ID NO: 129595 - DNA, 45 bp, Homo sapiens; identical to SEQ ID NO: 99775
  misc_feature 1..45: note = chr8:71115137-71115182
  misc_feature 1..45: note = Hypo
  source 1..45: mol_type = genomic DNA

SEQ ID NO: 129596 - DNA, 30 bp, Homo sapiens; identical to SEQ ID NO: 99776
  misc_feature 1..30: note = chr8:71240462-71240492
  misc_feature 1..30: note = Hypo
  source 1..30: mol_type = genomic DNA

SEQ ID NO: 129597 - DNA, 213 bp, Homo sapiens; identical to SEQ ID NO: 41821
  misc_feature 1..213: note = chr8:71368455-71368668
  misc_feature 1..213: note = Hypo
  source 1..213: mol_type = genomic DNA

SEQ ID NO: 129598 - DNA, 37 bp, Homo sapiens; identical to SEQ ID NO: 99778
  misc_feature 1..37: note = chr8:71448087-71448124
  misc_feature 1..37: note = Hypo
  source 1..37: mol_type = genomic DNA

SEQ ID NO: 129599 - DNA, 30 bp, Homo sapiens; identical to SEQ ID NO: 99779
  misc_feature 1..30: note = chr8:71522730-71522760
  misc_feature 1..30: note = Hypo
  source 1..30: mol_type = genomic DNA

SEQ ID NO: 129600 - DNA, 30 bp, Homo sapiens; identical to SEQ ID NO: 99780
  misc_feature 1..30: note = chr8:71582179-71582209
  misc_feature 1..30: note = Hypo
  source 1..30: mol_type = genomic DNA

SEQ ID NO: 129601 - DNA, 402 bp, Homo sapiens; identical to SEQ ID NO: 99781
  misc_feature 1..402: note = chr8:72273868-72274270
  misc_feature 1..402: note = Hyper
  source 1..402: mol_type = genomic DNA

SEQ ID NO: 129602 - DNA, 938 bp, Homo sapiens
  misc_feature 1..938: note = chr8:72459598-72460536
  misc_feature 1..938: note = Hyper
  source 1..938: mol_type = genomic DNA
cgaaggaaaacaaaccggcccttgacacatccctccacgtgcagcgcccgacgccacgggccttgggcggctgcacctctcccctgccggccacggctcaaggccccattattgcgcgcacccagctcccttccaggtgactttcgcgtacctggcggcggcgccctaggcctcggaggctgcccgggcgggctggggctcgggcggcgctcgctgagagtcgcggcgcccctcagccgcttcccgggcgccgatcgccgccctcctgccccggggtggggcccaggggcatcagcagccgcgggctctcggccgccgcctgggaactcagggtcagatttagtttcacaacaacgtctcctcgtcacggcaacccaactggaggcagaagccggcggggcggccgagcggggcggggcgggagcgcggccgccgcgagccacggtggggagcgggcgcgggggaccctggcgggccccgggcagcgcggctgcacttacttgtgtcacaactgcggcgacggggggctgaggaaccggttcttccaaaagcaaaccgaaaatgggtaacagagaggccggggcagcgctaagaggggttctgcctcggtgtttagggcaaaaaacccggctccggcttccagaaattcgagccagcggtggctttttctttctttcctctctaaacgctcctgtgcctccgggtcgaggggcgcccttcgcgcggctccgagtgcacagcgacaccagggctggcgctggagaggggagccctcttcccagcacccctcgggtctcccccgtacccccacccacagcccctttcctgggcccgacgcccctccgctctgcagccggagcctgggcctggtgcccactgccccgcggggtgtctcggacgcctggcccctgcagcgttttctacggagaggcctcaga

SEQ ID NO: 129603 - DNA, 30 bp, Homo sapiens; identical to SEQ ID NO: 99783
  misc_feature 1..30: note = chr8:72466268-72466298
  misc_feature 1..30: note = Hyper
  source 1..30: mol_type = genomic DNA

SEQ ID NO: 129604 - DNA, 1020 bp, Homo sapiens; identical to SEQ ID NO: 99784
  misc_feature 1..1020: note = chr8:72468554-72469574
  misc_feature 1..1020: note = Hyper
  source 1..1020: mol_type = genomic DNA

SEQ ID NO: 129605 - DNA, 499 bp, Homo sapiens; identical to SEQ ID NO: 99785
  misc_feature 1..499: note = chr8:72470336-72470835
  misc_feature 1..499: note = Hyper
  source 1..499: mol_type = genomic DNA

SEQ ID NO: 129606 - DNA, 79 bp, Homo sapiens; identical to SEQ ID NO: 99786
  misc_feature 1..79: note = chr8:72471116-72471195
  misc_feature 1..79: note = Hyper
  source 1..79: mol_type = genomic DNA

SEQ ID NO: 129607 - DNA, 930 bp, Homo sapiens
  misc_feature 1..930: note = chr8:72754310-72755240
  misc_feature 1..930: note = Hyper
  source 1..930: mol_type = genomic DNA
cagcggccttcctcccgcccgttagaagggcgctgtgctggagtacgaacccggcccagagaagccactcgcccttctttgtcacttaaaaccctgtcccgacgcggatctcacgtctagacctctgtctttaaagcggatgtagagcgcgttctaaccgttccctaaccattgtgtcaccgcgaaaggccggggctgtgtggaaccgtcccgcacgtgtgcgatgaatctggctccgctgagaacggatccgtgggctgtctggcgcgggctggggcagcagccgagagttagtctacagagctagggcccgagggtggacctgcgtccgcgtctcgtcacgaaaggaagctctttttggagaggcaaaacgtggtcgcccagatccggcgcagctgtagccgtgggcgctgtgcagtgacagccacacccgccacctgtcacgatcacagttccagggaaaggggaagggtcaaggagaatccagcggaaacttcttcccatctcacgagctctcccttctctccgtggcccccaaacactcgcatttaacgaataatcccatcaagtgagttccagtccgatttaagcggtggttccacatagtctgttggctgcggaaacttctttggtgtcagagtccggtcttcccgagaccacgaatggccatgtctgtaaatcaaaaagaacgtgagatattagagagaaacgattgtctcaaaccgaaacagctctcctacgcgaaccccagatattcctgacttggagtagctaagattttatcagcattctgggaatttgcatgtcctctctctgaactaagattttcattttactggaggttgataatccgagacttgccatatccgttcacgcttcttcctggactttgcccgcaggataatttggtgaaactcatctgactttgag

SEQ ID NO: 129608 - DNA, 1649 bp, Homo sapiens
  misc_feature 1..1649: note = chr8:72755300-72756949
  misc_feature 1..1649: note = Hyper
  source 1..1649: mol_type = genomic DNA
acacacacacacacacagtcatccactccaagctccaagtaggaactgggcttggacaggatttttcccaagccgggagagctggcagatcagagagggactttccagataaatcccatctggggaaacgttactatcttccacaagcaatttttctaaaaatgcaaatgctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaacgatgcaaacagacacggagggttgattcttcttcagggaaatggctggccactcccttgatttgggagaaactaaactggccttctcgttcccagtcccagaacctccacccctttcgaattcttcccaacgggctgaccctgcccggcgcccaggagcgccctgggtatctcctggctgctctcccgaatccttgcgcgccgcgcccctaccaggttcactgggtgcacgtagccgttctcatagcggtcctcctgcaacagctgccgcaggtgagcgatgtaactggaagccagccggagcgtgtccagcttggagagcttagtgtcggggggcacccagggcaggctggtcttgagcctggagaaggctttgctcagcacgcgcatccgggcacgctcacgggcgttggccgcgttccgctgcgactgcttgcactctgcggctgagcccttggccgggaggggcttcttgccaccaccgcccgcgctaccacctgcgccgccgcccccagccacacggggccgcttcctcttgcagccttccgcgctgccggctgtgcccagagcgcagcgctcctcctcgccgtcggggtcctcctcctctgccgacgagttgtcactgggcgaggcgtagctgcgctctacgccgcggaggggcggcctcttggaggcggggaccgggtactcccgctgcagcccccgaagctccatctcctccggatcactcaccgagcccgtggacatcccgttgtcccccttgcccacacgcgtcctctttcctcccccctggccagtctcgctgtctccgccttccgctccctggcggaggcggaggccagagagcgctccaaggaagactaaaaacccaggccgggaagcgcggggtgagaaagcgaggtgggtggcgagagcgtgagcgcccctctgctgaccccggggagcgtggactacgagttggcgcccaagtccagaatccgcgcgcaccgcggtaagctgcgccttttgaaaaggctatctgtactccttggaacaaaccaccccgggcaaagaagagggggttgtaaagggggccaagaggtggggcaggggcgtggaaggggtggggaccgcttttctgcatgccgaagagcggttggtggaggcgggggaaggggacgtctctgcagagccgagatttgggctctgaagcccgacggcccttcaacatgtctgcgcaggataagtgagctttcggggagtgaaggggcacatcttgttcctaccgacggtgcttctacccc

SEQ ID NO: 129609 - DNA, 30 bp, Homo sapiens; identical to SEQ ID NO: 99792
  misc_feature 1..30: note = chr8:72782820-72782850
  misc_feature 1..30: note = Hypo
  source 1..30: mol_type = genomic DNA

SEQ ID NO: 129610 - DNA, 30 bp, Homo sapiens; identical to SEQ ID NO: 99793
  misc_feature 1..30: note = chr8:72855159-72855189
  misc_feature 1..30: note = Hypo
  source 1..30: mol_type = genomic DNA

SEQ ID NO: 129611 - DNA, 96 bp, Homo sapiens
  misc_feature 1..96: note = chr8:72917369-72917465
  misc_feature 1..96: note = Hyper
  source 1..96: mol_type = genomic DNA
tcaaggcttgcaggtcgtctccaggagtcagagaggtccggactccggggattcctgctccgcggagaactggggagcccccgttcctgtgccact

SEQ ID NO: 129612 - DNA, 30 bp, Homo sapiens; identical to SEQ ID NO: 99795
  misc_feature 1..30: note = chr8:72917679-72917709
  misc_feature 1..30: note = Hyper
  source 1..30: mol_type = genomic DNA

SEQ ID NO: 129613 - DNA, 494 bp, Homo sapiens
  misc_feature 1..494: note = chr8:72987542-72988036
  misc_feature 1..494: note = Hyper
  source 1..494: mol_type = genomic DNA
ttccttgaaatcctccgtgtcgtccggcacatcctcatagacaacgccctggggctccttcttttctccagggcgccacatcttcctcaggctgcgcttcattgaccccaccccggacgccacctggtgcagctgctcaccacgcgcgcgggcacctggggcgagagagcgctgtcagcctgccaggcgctggggtccgcgcgagcccgagctctcccgcgctgcagctcacaggcagcgaaaaagtcgctctgcggaagccctggagaacttctggaaggagttctcaggcccgcgctacttttgtagtgcaggaagcaggcggggcgcggagaggaggtagaaacgcggagctccttcgcaaagagggcggcggcgccgcgtctgccttggactcgccccttcagggacaaagtgactcgcccgtcccgctgtcctgcagctgcagcagcgcactgacggagtcaagcgtgtcaggtcggggtggattgcag

SEQ ID NO: 129614 - DNA, 747 bp, Homo sapiens
  misc_feature 1..747: note = chr8:73163497-73164244
  misc_feature 1..747: note = Hyper
  source 1..747: mol_type = genomic DNA
aatagataaagcaggcgctgtgtgggcgcgtcattagcggggtctcctcttggactgtgaacacaccccaaagcttgcaaccccctggccactccacgctttctccaaaccaagggctgcccgcaaggaaacctcgagccgaaccgcggccggacttcagaacccgtcccgacccgcgaacccccagggtaccttaagcggttccttgcagtcctccgtgtcgtcccgcacatcctcatagacaacgccctggggctccttcttttctccagggcgccacatcttcctcgggctgcgcttcattgaccccaccccggacgccatctggtgcatctgctccccacgagcgcgggcacctggggcgagagagcgctgtcagccggccaggcgctggggtccgcgcgagcccgagctctccctcgctgcagctcacaggcagcgaaaatctcgctccgcgagagccctggagaacttctggaaggagttctcaggcccgcgctacttacagtgcaggaagcaagcggggcgtgaagaggaggtagaaacacagacctccctagcaaagagggaggcggcgcagcgtctgccgaggactcgccccttcaggaacaaagtgactcccccgtcccgctgtcctgcagctgcagcagcgcactcccagagtcaagcgtgtcaggtcggtgtggatgcagcgaatttgttgtaatctacacattaagagcccccttgcctcgccctgccccctcc

SEQ ID NO: 129615 - DNA, 46 bp, Homo sapiens; identical to SEQ ID NO: 9640
  misc_feature 1..46: note = chr8:73448786-73448832
  misc_feature 1..46: note = Hyper
  source 1..46: mol_type = genomic DNA

SEQ ID NO: 129616 - DNA, 30 bp, Homo sapiens; identical to SEQ ID NO: 32100
  misc_feature 1..30: note = chr8:73449084-73449114
  misc_feature 1..30: note = Hyper
  source 1..30: mol_type = genomic DNA

SEQ ID NO: 129617 - DNA, 55 bp, Homo sapiens; identical to SEQ ID NO: 99802
  misc_feature 1..55: note = chr8:73449377-73449432
  misc_feature 1..55: note = Hyper
  source 1..55: mol_type = genomic DNA

SEQ ID NO: 129618 - DNA, 523 bp, Homo sapiens
  misc_feature 1..523: note = chr8:73449639-73450162
  misc_feature 1..523: note = Hyper
  source 1..523: mol_type = genomic DNA
ctcgggcagccccagcgagcggcaactcccgggctggcgcggctcgctttctggctccttccgcgcggcgagctcagccccgctcgatttttcctcttctgttccagccctctcttgtctgggtggctgtggcggcggcagggggatggggaccccgtgtggggaaggggttgaagatcgatgaagattattgttcttttaaaggatgccttagcttcctcccgccgcctttcctctgagccttcctactagagaccgtgaaccagagtcagggatgtaaagacagggggaaagcacgccgggagctccagccagccggggagaccctcctctctgtggaggggagggggatttccagcgacaggtcattggcgaaggggatcgtcgcggggagaggctccccggagggagcggggaatcccacagccctttgtggtgcccgagcccgtgccgcctgctgagcggggtctgtgggagctaggtaagtggcgggggcattgctgctccccgaagggggtcttcc

SEQ ID NO: 129619 - DNA, 119 bp, Homo sapiens; identical to SEQ ID NO: 99805
  misc_feature 1..119: note = chr8:73450471-73450590
  misc_feature 1..119: note = Hyper
  source 1..119: mol_type = genomic DNA

SEQ ID NO: 129620 - DNA, 218 bp, Homo sapiens; identical to SEQ ID NO: 99806
  misc_feature 1..218: note = chr8:73802558-73802776
  misc_feature 1..218: note = Hypo
  source 1..218: mol_type = genomic DNA

SEQ ID NO: 129621 - DNA, 18 bp, Homo sapiens
  misc_feature 1..18: note = chr8:73966731-73966749
  misc_feature 1..18: note = Hypo
  source 1..18: mol_type = genomic DNA
aagcgttgagtcaccgcg

SEQ ID NO: 129622 - DNA, 113 bp, Homo sapiens; identical to SEQ ID NO: 99808
  misc_feature 1..113: note = chr8:74005057-74005170
  misc_feature 1..113: note = Hyper
  source 1..113: mol_type = genomic DNA

SEQ ID NO: 129623 - DNA, 30 bp, Homo sapiens; identical to SEQ ID NO: 99809
  misc_feature 1..30: note = chr8:74005509-74005539
  misc_feature 1..30: note = Hyper
  source 1..30: mol_type = genomic DNA

SEQ ID NO: 129624 - DNA, 34 bp, Homo sapiens; identical to SEQ ID NO: 99810
  misc_feature 1..34: note = chr8:74086196-74086230
  misc_feature 1..34: note = Hypo
  source 1..34: mol_type = genomic DNA

SEQ ID NO: 129625 - DNA, 46 bp, Homo sapiens; identical to SEQ ID NO: 99811
  misc_feature 1..46: note = chr8:74332799-74332845
  misc_feature 1..46: note = Hypo
  source 1..46: mol_type = genomic DNA

SEQ ID NO: 129626 - DNA, 54 bp, Homo sapiens; identical to SEQ ID NO: 99812
  misc_feature 1..54: note = chr8:74674435-74674489
  misc_feature 1..54: note = Hypo
  source 1..54: mol_type = genomic DNA

SEQ ID NO: 129627 - DNA, 101 bp, Homo sapiens; identical to SEQ ID NO: 41825
  misc_feature 1..101: note = chr8:74759410-74759511
  misc_feature 1..101: note = Hypo
  source 1..101: mol_type = genomic DNA

SEQ ID NO: 129628 - DNA, 44 bp, Homo sapiens; identical to SEQ ID NO: 41826
  misc_feature 1..44: note = chr8:74759819-74759863
  misc_feature 1..44: note = Hypo
  source 1..44: mol_type = genomic DNA

SEQ ID NO: 129629 - DNA, 30 bp, Homo sapiens; identical to SEQ ID NO: 99815
  misc_feature 1..30: note = chr8:74848031-74848061
  misc_feature 1..30: note = Hypo
  source 1..30: mol_type = genomic DNA

SEQ ID NO: 129630 - DNA, 157 bp, Homo sapiens; identical to SEQ ID NO: 99816
  misc_feature 1..157: note = chr8:74962845-74963002
  misc_feature 1..157: note = Hypo
  source 1..157: mol_type = genomic DNA

SEQ ID NO: 129631 - DNA, 37 bp, Homo sapiens; identical to SEQ ID NO: 99818
  misc_feature 1..37: note = chr8:75232634-75232671
  misc_feature 1..37: note = Hyper
  source 1..37: mol_type = genomic DNA

SEQ ID NO: 129632 - DNA, 160 bp, Homo sapiens; identical to SEQ ID NO: 99819
  misc_feature 1..160: note = chr8:75232938-75233098
  misc_feature 1..160: note = Hyper
  source 1..160: mol_type = genomic DNA

SEQ ID NO: 129633 - DNA, 57 bp, Homo sapiens; identical to SEQ ID NO: 99820
  misc_feature 1..57: note = chr8:75233984-75234041
  misc_feature 1..57: note = Hyper
  source 1..57: mol_type = genomic DNA

SEQ ID NO: 129634 - DNA, 34 bp, Homo sapiens; identical to SEQ ID NO: 99821
  misc_feature 1..34: note = chr8:75733579-75733613
  misc_feature 1..34: note = Hypo
  source 1..34: mol_type = genomic DNA

SEQ ID NO: 129635 - DNA, 840 bp, Homo sapiens
  misc_feature 1..840: note = chr8:75896554-75897394
  misc_feature 1..840: note = Hyper
  source 1..840: mol_type = genomic DNA
cacgcccacaaaggccgagcgccctggcttcgctgcgttccggagaagcagggcgggctgcttctcccggatctggcgggcctctggccacggctggttggaggtgggggtgggcgaggaggggcgctcaagtcacgtgcccgcgctggggccgcaataaatgctcgcgaacgcgagagagcgacggaagcgctaggcgcctggttctgcgcgtactggctgtacggagcaggagcaagaggtcgccgccagcctccgccgccgagcctcgttcgtgtccccgcccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagaggtaagggcgattctaaaatgcatcgctgagtcgtcaagctgccaccctttcctatctccctttgccttcttaaactgtacttaaaaaaaaaaaaaagccaactgtacagagtggttgggcgcgatgggtgggtgggctacccggaaagcagcgacgatagaaattagcgggagctctagttcttgtaagtgactttgttggtttcacctactttctctgtcgcgcgctttccatttgag

SEQ ID NO: 129636 - DNA, 87 bp, Homo sapiens; identical to SEQ ID NO: 99825
  misc_feature 1..87: note = chr8:76008456-76008543
  misc_feature 1..87: note = Hypo
  source 1..87: mol_type = genomic DNA

SEQ ID NO: 129637 - DNA, 692 bp, Homo sapiens
  misc_feature 1..692: note = chr8:76316303-76316995
  misc_feature 1..692: note = Hyper
  source 1..692: mol_type = genomic DNA
gtcccagttgcagtccgctattgctccaggcccagcgggggcggacctcgttggaggctacggtgcaggtcggagaagatgaaatggcctagcatcccccttcccaggggctcgagtcggcagctttagagctccgacaatctgtgccctcgctttgggctgcgccagggagcaaaaaacctctgcttttttgaaagaggccggggcaacaaggtagagagccgcggccagaagcagccccgggccataaacccgaggcctggatggcttaaggctgaaaccgcctccgcccccaccctcaccctgctggccgagccctcccccctcctagccacagtgaccggaatcccagacttcccttctgatgcataaaacattcagtggcctccagggagtttttgaaattctggcggaggctgctttatccgttgtttcgccccctgggtcaaacactggtccactgggtgagttggaggagcgagtagctcagctatagattaaatttaacctgagccccggtggccgcgtcccgcccgcggtcctttctatacgagtagctttgaaggtgtcaccgagctgtgcccaaatctagaaaagaatgggaggagaactgcatgagcttttaattttcttccctttttccccccttcctgcgtgtaaactggggtaagggtgggcggtaatccccactg

SEQ ID NO: 129638 - DNA, 64 bp, Homo sapiens; identical to SEQ ID NO: 99828
  misc_feature 1..64: note = chr8:76319856-76319920
  misc_feature 1..64: note = Hyper
  source 1..64: mol_type = genomic DNA

SEQ ID NO: 129639 - DNA, 56 bp, Homo sapiens; identical to SEQ ID NO: 99829
  misc_feature 1..56: note = chr8:76320236-76320292
  misc_feature 1..56: note = Hyper
  source 1..56: mol_type = genomic DNA

SEQ ID NO: 129640 - DNA, 30 bp, Homo sapiens; identical to SEQ ID NO: 99830
  misc_feature 1..30: note = chr8:76836378-76836408
  misc_feature 1..30: note = Hypo
  source 1..30: mol_type = genomic DNA

SEQ ID NO: 129641 - DNA, 23 bp, Homo sapiens
  misc_feature 1..23: note = chr8:76861290-76861313
  misc_feature 1..23: note = Hypo
  source 1..23: mol_type = genomic DNA
ccagacgcggtggttcgcaccta

SEQ ID NO: 129642 - DNA, 1618 bp, Homo sapiens; identical to SEQ ID NO: 99832
  misc_feature 1..1618: note = chr8:77585073-77586691
  misc_feature 1..1618: note = Hyper
  source 1..1618: mol_type = genomic DNA

SEQ ID NO: 129643 - DNA, 30 bp, Homo sapiens; identical to SEQ ID NO: 99833
  misc_feature 1..30: note = chr8:77586986-77587016
  misc_feature 1..30: note = Hyper
  source 1..30: mol_type = genomic DNA

SEQ ID NO: 129644 - DNA, 606 bp, Homo sapiens; identical to SEQ ID NO: 99834
  misc_feature 1..606: note = chr8:77590098-77590704
  misc_feature 1..606: note = Hyper
  source 1..606: mol_type = genomic DNA

SEQ ID NO: 129645 - DNA, 2320 bp, Homo sapiens
  misc_feature 1..2320: note = chr8:77593174-77595494
  misc_feature 1..2320: note = Hyper
  source 1..2320: mol_type = genomic DNA
gtttgtgtgtaagagcgcgtgtgtgtctaatgaagtttgggagtcgcgcgcaggggcgcgtagggtgcgagacccggaggtccccatcccctgtcctctccgcggtcgccgcatccggggctccagccgcagcgctgggagctttggaagccgtgaggctccggagctgctctgagtccgggctgcgcgtcatttgcagtctggggaatgttgatcacctcactaattacacctctctctcccccctctccctctccctctccctcgctctcctctctcattcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtaagttttttctttaacttttattgagtagtttctgttaaatttaggtcgagtatcgattatctttccagcctgatcttgcacaatctttgatatttcgctccctctctctccctctccgcctctcttcctctctacccctacctcgctcgctcctgctcgctgtcgcacacatcccctcatcccgaccatctcttccgctctgccccccttttctatctctttccccttttttttggctcaaggttttgctccgctgagggagggagggggcactgagggacctgattttccactttctttaggggggctgcgtttttccggatttaacttttggattaagtggcggaggatcatctacgtttgcttgggcagttttctctccttttccctgtcttttcgggttttgccttccccgcgagccccgggcattctagtggctgggggaagctgtcagctccgcaacggcgcgggcactgccaggggtctccgctcgccccgcgcccctgcaccccgatcgggatgactggtcctccgcactcatcctctgaaagtttggacgttggtcggtggggctgggagcccctctctccctgctctttccctgctttaccctccaccccccaccccaccttattcagcctcgtttttcttcctccttttaccacccgcccctcttccccttctcaagttccccgaaggtcgcttagtgtgcggggctggcggaggcccgggggttcgtgagctctggggaggggattccaagaggctggggtgaacgctggggctggggctgcaggtagacacccgcccaccggagcgggcgcggcaggcactaccgagggctgctctcggcggcgcgggcgcgggcgccgcggaggaaaggcaggtccgttaggaggcgggatcgcccggcctctgggccagggacccgcgaggcggcggctgcttgctccgaacggaacgccgccgggtgtgcgttagaccagcggatagacgcccgcggcttggggtcaagaatcttttcctttttagcaaagggcaaggggtgtgtgcgtgtgcgtgtgcgtgtgtgtgtgtgtattgagtggctgtgttcggctgtgagaaccgattcattcttcggcccccctaaaagggttccatgcctacaaatgaacttcacctccttcgtttctccaagcatcaagtgcgccttctggctgggagcagctaagggaaaagggactggaatgcgccgggtctctccttccttctacttctatccacccccaacccccttctcgctcctcttttctatcagaaaaaaataataaaatctctcatggaattgtataaagtttctctgccgatgtccaagttacagaaggttccctattctaatccccttcccctagaagacggtgcactggtttctatttcttttgttacctgtgatccgggcggggggctcctttcggccgctcgggctggggtccggcccagagaggaggcttctgcgggcgcctttggccgcgacttctcacttccgcgcggttctggtgaggttttagctaccgttcggtgagacaccctccttgtaggtaccaaaggttcagatcgcaaacacggaccccccccacctcgacccctacacaca

SEQ ID NO: 129646 - DNA, 30 bp, Homo sapiens; identical to SEQ ID NO: 99839
  misc_feature 1..30: note = chr8:77595977-77596007
  misc_feature 1..30: note = Hyper
  source 1..30: mol_type = genomic DNA

SEQ ID NO: 129647 - DNA, 415 bp, Homo sapiens; identical to SEQ ID NO: 99840
  misc_feature 1..415: note = chr8:78532894-78533309
  misc_feature 1..415: note = Hypo
  source 1..415: mol_type = genomic DNA

SEQ ID NO: 129648 - DNA, 759 bp, Homo sapiens; identical to SEQ ID NO: 99843
  misc_feature 1..759: note = chr8:79428289-79429048
  misc_feature 1..759: note = Hyper
  source 1..759: mol_type = genomic DNA

SEQ ID NO: 129649 - DNA, 30 bp, Homo sapiens; identical to SEQ ID NO: 99844
  misc_feature 1..30: note = chr8:79674707-79674737
  misc_feature 1..30: note = Hyper
  source 1..30: mol_type = genomic DNA

SEQ ID NO: 129650 - DNA, 30 bp, Homo sapiens; identical to SEQ ID NO: 99845
  misc_feature 1..30: note = chr8:79844975-79845005
  misc_feature 1..30: note = Hypo
  source 1..30: mol_type = genomic DNA

SEQ ID NO: 129651 - DNA, 30 bp, Homo sapiens; identical to SEQ ID NO: 99846
  misc_feature 1..30: note = chr8:80086720-80086750
  misc_feature 1..30: note = Hypo
  source 1..30: mol_type = genomic DNA

SEQ ID NO: 129652 - DNA, 162 bp, Homo sapiens; identical to SEQ ID NO: 41828
  misc_feature 1..162: note = chr8:80483857-80484019
  misc_feature 1..162: note = Hypo
  source 1..162: mol_type = genomic DNA

SEQ ID NO: 129653 - DNA, 664 bp, Homo sapiens
  misc_feature 1..664: note = chr8:80523889-80524553
  misc_feature 1..664: note = Hyper
  source 1..664: mol_type = genomic DNA
attgcaaagtcaaagcggtcccatcccgctgtttgaaagatgggtggagacggggggaggggatggagagaactgggcacattttacggtattgtctcgtcgaagaaaccgctagtcctggggtgcggtgcagggaggtaagacggcgggggacagggtgggggtaggacctccgctcctttgttttagggcaagggaggggaaggagagaggaagtcgcggagggcgtggagggcgcgggtgggcagctgcaggggcggggaagcgcgcggcagggaggggtggagggacagcggcttcgaaggcgctggggtggggtttctttgtgtgcggaccagcggtcccggggggaggcacctgcagcgctgggcgcacaatgcggacagccccacccagtgcggaaccgcgcagccccgcccccccgcccggtgctgcatcttcattcgaaagggggtcgggtggggagcgcagcgtgacacccaggagcccaaccctgcggggacagcggcgccacgccccgcgctccccgctcccgactccccgccgcggcttccaagagagacctgaccactgaccccgccctccccacgctggcctcattgttctgcttttaagagagatgggaaaagtgggttaacatttttcttttcggaagcaaattaca

SEQ ID NO: 129654 - DNA, 928 bp, Homo sapiens; identical to SEQ ID NO: 32123
  misc_feature 1..928: note = chr8:80524845-80525773
  misc_feature 1..928: note = Hyper
  source 1..928: mol_type = genomic DNA

SEQ ID NO: 129655 - DNA, 38 bp, Homo sapiens; identical to SEQ ID NO: 99851
  misc_feature 1..38: note = chr8:80677743-80677781
  misc_feature 1..38: note = Hyper
  source 1..38: mol_type = genomic DNA

SEQ ID NO: 129656 - DNA, 30 bp, Homo sapiens; identical to SEQ ID NO: 99852
  misc_feature 1..30: note = chr8:80695916-80695946
  misc_feature 1..30: note = Hyper
  source 1..30: mol_type = genomic DNA

SEQ ID NO: 129657 - DNA, 30 bp, Homo sapiens; identical to SEQ ID NO: 99853
  misc_feature 1..30: note = chr8:80696233-80696263
  misc_feature 1..30: note = Hyper
  source 1..30: mol_type = genomic DNA

SEQ ID NO: 129658 - DNA, 572 bp, Homo sapiens
  misc_feature 1..572: note = chr8:80803328-80803900
  misc_feature 1..572: note = Hyper
  source 1..572: mol_type = genomic DNA
ttttccttgtcaatacgaaaatctttgagtacaaatcgataaagctagagattcaaagactgcctttataaaactggagaagatgcactctggccataggcggagggggcagcccggggcccctgtcaggaagccaagcggcccggggcatccctggaaggctgccgagggggcagcgccttctctggggacggcttcgtggagagtccgggacgggcgagacagaaaaccgagccctatttgttattagtatttttttttttatactctcaaatgccaccggcacattcttttaaaaaaaaatgaaaggaaagaaagaaagaaaaagaaaataagagaggaaaaggtcctgagaaatgacggacgcttgaacctcgggcccgggaagaccagcgccctttggcggctaggcctcgggggcgtgcggagggcgggcccccgcgcggccgccgctttcccaggccgccaggggtgaggaggtgacgctgcgggcttggtggcggctggtttttcacacaggaatcctcctcgccaccgctccctcgaaggccgccccccgctccacccccagc

SEQ ID NO: 129659 - DNA, 30 bp, Homo sapiens; identical to SEQ ID NO: 99855
  misc_feature 1..30: note = chr8:80804344-80804374
  misc_feature 1..30: note = Hypo
  source 1..30: mol_type = genomic DNA

SEQ ID NO: 129660 - DNA, 96 bp, Homo sapiens; identical to SEQ ID NO: 99856
  misc_feature 1..96: note = chr8:81051849-81051945
  misc_feature 1..96: note = Hypo
  source 1..96: mol_type = genomic DNA

SEQ ID NO: 129661 - DNA, 35 bp, Homo sapiens; identical to SEQ ID NO: 99857
  misc_feature 1..35: note = chr8:81052005-81052040
  misc_feature 1..35: note = Hypo
  source 1..35: mol_type = genomic DNA

SEQ ID NO: 129662 - DNA, 30 bp, Homo sapiens; identical to SEQ ID NO: 99858
  misc_feature 1..30: note = chr8:81084313-81084343
  misc_feature 1..30: note = Hypo
  source 1..30: mol_type = genomic DNA

SEQ ID NO: 129663 - DNA, 20 bp, Homo sapiens
  misc_feature 1..20: note = chr8:81085073-81085093
  misc_feature 1..20: note = Hypo
  source 1..20: mol_type = genomic DNA
aaaacaggcctggcacggtg

SEQ ID NO: 129664 - DNA, 38 bp, Homo sapiens; identical to SEQ ID NO: 99860
  misc_feature 1..38: note = chr8:81213318-81213356
  misc_feature 1..38: note = Hypo
  source 1..38: mol_type = genomic DNA

SEQ ID NO: 129665 - DNA, 38 bp, Homo sapiens; identical to SEQ ID NO: 99861
  misc_feature 1..38: note = chr8:81309040-81309078
  misc_feature 1..38: note = Hypo
  source 1..38: mol_type = genomic DNA

SEQ ID NO: 129666 - DNA, 101 bp, Homo sapiens; identical to SEQ ID NO: 32125
  misc_feature 1..101: note = chr8:81400332-81400433
  misc_feature 1..101: note = Hyper
  source 1..101: mol_type = genomic DNA

SEQ ID NO: 129667 - DNA, 398 bp, Homo sapiens; identical to SEQ ID NO: 99863
  misc_feature 1..398: note = chr8:81478129-81478527
  misc_feature 1..398: note = Hyper
  source 1..398: mol_type = genomic DNA

SEQ ID NO: 129668 - DNA, 70 bp, Homo sapiens; identical to SEQ ID NO: 99864
  misc_feature 1..70: note = chr8:81786854-81786924
  misc_feature 1..70: note = Hyper
  source 1..70: mol_type = genomic DNA

SEQ ID NO: 129669 - DNA, 1074 bp, Homo sapiens; identical to SEQ ID NO: 99865
  misc_feature 1..1074: note = chr8:82192624-82193698
  misc_feature 1..1074: note = Hyper
  source 1..1074: mol_type = genomic DNA

SEQ ID NO: 129670 - DNA, 193 bp, Homo sapiens; identical to SEQ ID NO: 99866
  misc_feature 1..193: note = chr8:82543083-82543276
  misc_feature 1..193: note = Hyper
  source 1..193: mol_type = genomic DNA

SEQ ID NO: 129671 - DNA, 219 bp, Homo sapiens; identical to SEQ ID NO: 99867
  misc_feature 1..219: note = chr8:82556628-82556847
  misc_feature 1..219: note = Hypo
  source 1..219: mol_type = genomic DNA

SEQ ID NO: 129672 - DNA, 30 bp, Homo sapiens; identical to SEQ ID NO: 99868
  misc_feature 1..30: note = chr8:82687586-82687616
  misc_feature 1..30: note = Hypo
  source 1..30: mol_type = genomic DNA

SEQ ID NO: 129673 - DNA, 90 bp, Homo sapiens; identical to SEQ ID NO: 99869
  misc_feature 1..90: note = chr8:82903043-82903133
  misc_feature 1..90: note = Hypo
  source 1..90: mol_type = genomic DNA

SEQ ID NO: 129674 - DNA, 52 bp, Homo sapiens; identical to SEQ ID NO: 99870
  misc_feature 1..52: note = chr8:83104515-83104567
  misc_feature 1..52: note = Hypo
  source 1..52: mol_type = genomic DNA

SEQ ID NO: 129675 - DNA, 91 bp, Homo sapiens; identical to SEQ ID NO: 99871
  misc_feature 1..91: note = chr8:83281998-83282089
  misc_feature 1..91: note = Hypo
  source 1..91: mol_type = genomic DNA

SEQ ID NO: 129676 - DNA, 38 bp, Homo sapiens; identical to SEQ ID NO: 99872
  misc_feature 1..38: note = chr8:84342394-84342432
  misc_feature 1..38: note = Hypo
  source 1..38: mol_type = genomic DNA

SEQ ID NO: 129677 - DNA, 340 bp, Homo sapiens
  misc_feature 1..340: note = chr8:85094516-85094856
  misc_feature 1..340: note = Hyper
  source 1..340: mol_type = genomic DNA
ggctcccgcggggtgcgccaccgcctcactgctggtacacgtctccccctctcgaccgccaagtgcttgctccctccaggcgagcactcacacaatggactcacttgtttcccatgcccctctcctttgacttccagcctcagcgaacaacttgagcaagagtcaaacaggagtctctgccatggagcatagacccttggagctttccagaccagctcagaagcacgggcgcacacacagacaaaacaatgccttgtccacgaatgaataaaggacacccatgcccccacccaccgctccgcaacccgcagaaagaaacccgggacggggtttcctaaat

SEQ ID NO: 129678 - DNA, 452 bp, Homo sapiens
  misc_feature 1..452: note = chr8:85095259-85095711
  misc_feature 1..452: note = Hyper
  source 1..452: mol_type = genomic DNA
cacctcctctcaaggcgctggatcagcacccctgagctgcccccacagcacacactcccaatgcgaggcggcggcggcagcaacagaggcagcagcagcaatcgcggcagcagcggcagaggcggcggcagctgcgcgcctcgggcccaaccccgctcggctccccctctcgccggcgccctgcctgtcttgcgtgtgcgtgtgcgtgtgctcagcctcagcgtgaggggcacctgctcgtctgggctcacagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctga

SEQ ID NO: 129679 - DNA, 133 bp, Homo sapiens; identical to SEQ ID NO: 99876
  misc_feature 1..133: note = chr8:85095983-85096116
  misc_feature 1..133: note = Hyper
  source 1..133: mol_type = genomic DNA

SEQ ID NO: 129680 - DNA, 199 bp, Homo sapiens; identical to SEQ ID NO: 99877
  misc_feature 1..199: note = chr8:85096522-85096721
  misc_feature 1..199: note = Hyper
  source 1..199: mol_type = genomic DNA

SEQ ID NO: 129681 - DNA, 439 bp, Homo sapiens
  misc_feature 1..439: note = chr8:85096781-85097220
  misc_feature 1..439: note = Hyper
  source 1..439: mol_type = genomic DNA
gtccgagcccgaggtggggagagcggcgcagggagccagggaaaaccaaagtccgttccctgcttcaggatcgttttctagatgtgcgcaaaatacagtcccctccccccacccctcccacggtgagctgcgcccaggtcgtctcccggcggggcgggtggcgtctgcgctgcgggccgcgccggccgggcactaggcggccggcgggccctgtaagttctccgagggccacttgcacagcaggaggggcgagggccgtgtacgtggcgctggccgtcgggcgggctagaggggaccctcagagcacccgggagatgggggtagaagcggcagagaccgcatattccggaggggctggctccaggccacgcgagccggagctggagacatttccagagccttgaggatggcaccggccctcgcacgctcaactcctgct

SEQ ID NO: 129682 - DNA, 19 bp, Homo sapiens
  misc_feature 1..19: note = chr8:85844268-85844287
  misc_feature 1..19: note = Hypo
  source 1..19: mol_type = genomic DNA
tttgagacaaagtctcgct

SEQ ID NO: 129683 - DNA, 30 bp, Homo sapiens; identical to SEQ ID NO: 99885
  misc_feature 1..30: note = chr8:86034879-86034909
  misc_feature 1..30: note = Hypo
  source 1..30: mol_type = genomic DNA

SEQ ID NO: 129684 - DNA, 103 bp, Homo sapiens; identical to SEQ ID NO: 99886
  misc_feature 1..103: note = chr8:86301028-86301131
  misc_feature 1..103: note = Hypo
  source 1..103: mol_type = genomic DNA

SEQ ID NO: 129685 - DNA, 30 bp, Homo sapiens; identical to SEQ ID NO: 99887
  misc_feature 1..30: note = chr8:86350528-86350558
  misc_feature 1..30: note = Hyper
  source 1..30: mol_type = genomic DNA

SEQ ID NO: 129686 - DNA, 114 bp, Homo sapiens; identical to SEQ ID NO: 41831
  misc_feature 1..114: note = chr8:86370822-86370936
  misc_feature 1..114: note = Hypo
  source 1..114: mol_type = genomic DNA

SEQ ID NO: 129687 - DNA, 199 bp, Homo sapiens; identical to SEQ ID NO: 99889
  misc_feature 1..199: note = chr8:86389517-86389716
  misc_feature 1..199: note = Hypo
  source 1..199: mol_type = genomic DNA

SEQ ID NO: 129688 - DNA, 29 bp, Homo sapiens
  misc_feature 1..29: note = chr8:86405563-86405592
  misc_feature 1..29: note = Hypo
  source 1..29: mol_type = genomic DNA
tgcacgggggatgggcgcggtgcctcaag

SEQ ID NO: 129689 - DNA, 36 bp, Homo sapiens; identical to SEQ ID NO: 41834
  misc_feature 1..36: note = chr8:86406813-86406849
  misc_feature 1..36: note = Hypo
  source 1..36: mol_type = genomic DNA

SEQ ID NO: 129690 - DNA, 26 bp, Homo sapiens
  misc_feature 1..26: note = chr8:86417676-86417702
  misc_feature 1..26: note = Hypo
  source 1..26: mol_type = genomic DNA
agaatcacaagcgtgagccactgtgc

SEQ ID NO: 129691 - DNA, 30 bp, Homo sapiens; identical to SEQ ID NO: 99895
  misc_feature 1..30: note = chr8:86428565-86428595
  misc_feature 1..30: note = Hypo
  source 1..30: mol_type = genomic DNA

SEQ ID NO: 129692 - DNA, 30 bp, Homo sapiens; identical to SEQ ID NO: 99896
  misc_feature 1..30: note = chr8:86432229-86432259
  misc_feature 1..30: note = Hypo
  source 1..30: mol_type = genomic DNA

SEQ ID NO: 129693 - DNA, 123 bp, Homo sapiens; identical to SEQ ID NO: 99897
  misc_feature 1..123: note = chr8:86436621-86436744
  misc_feature 1..123: note = Hypo
  source 1..123: mol_type = genomic DNA

SEQ ID NO: 129694 - DNA, 42 bp, Homo sapiens; identical to SEQ ID NO: 99898
  misc_feature 1..42: note = chr8:86437022-86437064
  misc_feature 1..42: note = Hypo
  source 1..42: mol_type = genomic DNA

SEQ ID NO: 129695 - DNA, 128 bp, Homo sapiens; identical to SEQ ID NO: 99899
  misc_feature 1..128: note = chr8:86468333-86468461
  misc_feature 1..128: note = Hypo
  source 1..128: mol_type = genomic DNA

SEQ ID NO: 129696 - DNA, 76 bp, Homo sapiens; identical to SEQ ID NO: 99900
  misc_feature 1..76: note = chr8:86495755-86495831
  misc_feature 1..76: note = Hypo
  source 1..76: mol_type = genomic DNA

SEQ ID NO: 129697 - DNA, 120 bp, Homo sapiens; identical to SEQ ID NO: 99901
  misc_feature 1..120: note = chr8:86544680-86544800
  misc_feature 1..120: note = Hypo
  source 1..120: mol_type = genomic DNA

SEQ ID NO: 129698 - DNA, 63 bp, Homo sapiens; identical to SEQ ID NO: 99902
  misc_feature 1..63: note = chr8:86556050-86556113
  misc_feature 1..63: note = Hypo
  source 1..63: mol_type = genomic DNA

SEQ ID NO: 129699 - DNA, 74 bp, Homo sapiens; identical to SEQ ID NO: 99905
  misc_feature 1..74: note = chr8:86849567-86849641
  misc_feature 1..74: note = Hypo
  source 1..74: mol_type = genomic DNA

SEQ ID NO: 129700 - DNA, 19 bp, Homo sapiens
  misc_feature 1..19: note = chr8:86926063-86926082
  misc_feature 1..19: note = Hypo
  source 1..19: mol_type = genomic DNA
accacgcctggctaatttt

SEQ ID NO: 129701 - DNA, 30 bp, Homo sapiens; identical to SEQ ID NO: 99907
  misc_feature 1..30: note = chr8:86953049-86953079
  misc_feature 1..30: note = Hypo
  source 1..30: mol_type = genomic DNA

SEQ ID NO: 129702 - DNA, 221 bp, Homo sapiens; identical to SEQ ID NO: 99908
  misc_feature 1..221: note = chr8:86976079-86976300
  misc_feature 1..221: note = Hypo
  source 1..221: mol_type = genomic DNA

SEQ ID NO: 129703 - DNA, 212 bp, Homo sapiens
  misc_feature 1..212: note = chr8:87081740-87081952
  misc_feature 1..212: note = Hyper
  source 1..212: mol_type = genomic DNA
ctcgggcccaggccccgcgcctccgacgccggcttggttttgaccttcgtgcttggcccaagccagcgctggtggccccgggaccaccttcctgctggcgccgcaccccatacccgcaacacgcccgccgctcgcgggacctggggactcgggaagcagccagccccgttcctccgccctttatcaaagagcagctgcgaggggcgggaccc

SEQ ID NO: 129704 - DNA, 197 bp, Homo sapiens; identical to SEQ ID NO: 99910
  misc_feature 1..197: note = chr8:87083708-87083905
  misc_feature 1..197: note = Hypo
  source 1..197: mol_type = genomic DNA

SEQ ID NO: 129705 - DNA, 32 bp, Homo sapiens; identical to SEQ ID NO: 99913
  misc_feature 1..32: note = chr8:88037278-88037310
  misc_feature 1..32: note = Hypo
  source 1..32: mol_type = genomic DNA

SEQ ID NO: 129706 - DNA, 498 bp, Homo sapiens; identical to SEQ ID NO: 41839
  misc_feature 1..498: note = chr8:88885698-88886196
  misc_feature 1..498: note = Hypo
  source 1..498: mol_type = genomic DNA

SEQ ID NO: 129707 - DNA, 941 bp, Homo sapiens; identical to SEQ ID NO: 32137
  misc_feature 1..941: note = chr8:89339042-89339983
  misc_feature 1..941: note = Hyper
  source 1..941: mol_type = genomic DNA

SEQ ID NO: 129708 - DNA, 941 bp, Homo sapiens
  misc_feature 1..941: note = chr8:89340043-89340984
  misc_feature 1..941: note = Hyper
  source 1..941: mol_type = genomic DNA
cacacacgcgcgcatacacacagcccgacacacacgcacgcgcgcttcttaaaggagacggctcataaaggattccccactacggtagggcgcaccggaggtatccagcccgcgacaagggccctggtttgagcacagctcttcgacagtatctcccatcccgcatccccgaggcaggcacccaggaacttgggcggctccattctttcttcccgcccaccctgccgcctcgcatctaaaaacgagtgcgcccctctccagccatgagctgggtggggctcaggctgcggaccctagtggggcctggggagcggcccaaccctggtcctggagagcggtcggcattcctgaggaagcggccctggaagaataggggcgctgggaatcagaggagcgcctggtcactgagcgcccctgggtggctcgggtcggtggccggggctgaccaagtttgggaagactgagatagcaaatcccgaacgtccaaaactttgttggggtcccgagcctgtggcctggtgtcttcctgaatcccctctaccatagctacattccgccttccaggcttgaggagtaggcacagggttttggtggcggactagacaaatacagaagcgggatgaaaacgctcactttccaagtgaacggtggacacacgcgcacagtgggacccgggagagatggtcctgggtgttaacaaaacatccgatgagagggatgggggcgctggaaagaaaccggctgcgggagccaggggaagggttggggaaagaaggagaagaagcagcctgaggaaaggcgagtaaagcagctggcaagggcgggaggaagaggctgctcgcagaccgagcgggggagaggctggcgggagctaggagagctgcaggcaagagggggaggcggctggcaagaagcacgggcgaacgcgggcagggaacttc

SEQ ID NO: 129709 - DNA, 79 bp, Homo sapiens; identical to SEQ ID NO: 99922
  misc_feature 1..79: note = chr8:89687899-89687978
  misc_feature 1..79: note = Hypo
  source 1..79: mol_type = genomic DNA

SEQ ID NO: 129710 - DNA, 17 bp, Homo sapiens
  misc_feature 1..17: note = chr8:89830498-89830515
  misc_feature 1..17: note = Hypo
  source 1..17: mol_type = genomic DNA
gccggaaaacatatgtc

SEQ ID NO: 129711 - DNA, 99 bp, Homo sapiens; identical to SEQ ID NO: 99925
  misc_feature 1..99: note = chr8:90768479-90768578
  misc_feature 1..99: note = Hypo
  source 1..99: mol_type = genomic DNA

SEQ ID NO: 129712 - DNA, 39 bp, Homo sapiens; identical to SEQ ID NO: 99926
  misc_feature 1..39: note = chr8:90768818-90768857
  misc_feature 1..39: note = Hypo
  source 1..39: mol_type = genomic DNA

SEQ ID NO: 129713 - DNA, 137 bp, Homo sapiens; identical to SEQ ID NO: 1578
  misc_feature 1..137: note = chr8:90913516-90913653
  misc_feature 1..137: note = Hypo
  source 1..137: mol_type = genomic DNA

SEQ ID NO: 129714 - DNA, 951 bp, Homo sapiens
  misc_feature 1..951: note = chr8:91094254-91095205
  misc_feature 1..951: note = Hyper
  source 1..951: mol_type = genomic DNA
aatccagccttctttcgcgcctgctggagctcctggatcaagttctgcagctcctttccttccaggtaaccacttcctgcaaagacaaagaggcacccaggtgtcagatatctcattccaagtgtctttcccgttcactttccaagacagttatctttctggcgacccgagaggctctctcttgcctggacgttgattaaccagcaaagtgtacagacggtgaagcgctcccctcctggggtatcaaactttagatccactgaggacaaaggaggatggttggggtgctaagcgcagccacagaaactttgggggggcagcattccccaatccctgctctctctctcctaccattaccgttcctggaaagacaaaagtttaaggttttgggattacggtggaaacaatataaactttcaggttgacagtttggcggccagtcggggagataagaagataagattaggcagaagggggaagaagtaaagaatagaaaggagggataatgggatcaggaggctcagaaaagggcaaagaatgggaaggggcatggaaacgggtcttgaaacagttaaaaagagaagataatcaccgtcagcgtcgaaatggagccagatctcgaaaaactgtgaggctgtgatgagggatgactgcaggtgggattctgccattgtacagcggggtgtgtgtctgggtgtgtgaatatgcgtgtgtctgtgtccgcgcgagggggagtgagcaaaagctcagcgtgtgcgcgagtcagggctgcggagggagacctgggcgcgggcgctgccgggcgctgtcctcggtgctgctcagctcagcgttcctccagagttctctccctacaccccgcacccagttctcagtatttatcccgacggccccaagccgggccacgcctcctccagcctcccattcctcactccccgcctcttgctctca

SEQ ID NO: 129715 - DNA, 26 bp, Homo sapiens
  misc_feature 1..26: note = chr8:91118371-91118397
  misc_feature 1..26: note = Hypo
  source 1..26: mol_type = genomic DNA
cttattattgccaggcgcgttggctc

SEQ ID NO: 129716 - DNA, 102 bp, Homo sapiens; identical to SEQ ID NO: 99932
  misc_feature 1..102: note = chr8:91130026-91130128
  misc_feature 1..102: note = Hypo
  source 1..102: mol_type = genomic DNA

SEQ ID NO: 129717 - DNA, 22 bp, Homo sapiens
  misc_feature 1..22: note = chr8:91163928-91163950
  misc_feature 1..22: note = Hypo
  source 1..22: mol_type = genomic DNA
gtaatccctgcacttcggcagg

SEQ ID NO: 129718 - DNA, 187 bp, Homo sapiens; identical to SEQ ID NO: 99934
  misc_feature 1..187: note = chr8:91179163-91179350
  misc_feature 1..187: note = Hypo
  source 1..187: mol_type = genomic DNA

SEQ ID NO: 129719 - DNA, 25 bp, Homo sapiens
  misc_feature 1..25: note = chr8:91359129-91359154
  misc_feature 1..25: note = Hypo
  source 1..25: mol_type = genomic DNA
tgagccaccacgcctggccttcctt

SEQ ID NO: 129720 - DNA, 36 bp, Homo sapiens; identical to SEQ ID NO: 99937
  misc_feature 1..36: note = chr8:91375278-91375314
  misc_feature 1..36: note = Hypo
  source 1..36: mol_type = genomic DNA

SEQ ID NO: 129721 - DNA, 27 bp, Homo sapiens
  misc_feature 1..27: note = chr8:91434639-91434666
  misc_feature 1..27: note = Hypo
  source 1..27: mol_type = genomic DNA
atggatcaggccgggcgcagtggctca

SEQ ID NO: 129722 - DNA, 30 bp, Homo sapiens; identical to SEQ ID NO: 99941
  misc_feature 1..30: note = chr8:91657391-91657421
  misc_feature 1..30: note = Hyper
  source 1..30: mol_type = genomic DNA

SEQ ID NO: 129723 - DNA, 577 bp, Homo sapiens
  misc_feature 1..577: note = chr8:91803676-91804253
  misc_feature 1..577: note = Hyper
  source 1..577: mol_type = genomic DNA
gctgctcaggacaaacgccctgccattcgtcccttctctctgtccggacgccctcctccatccctgcacttggggccgtcgtggggctggtaggggtccccaggctatctccagccgtggccgatggccgtgccgggggcagagcccgctcccctccgcgcgttgctacgtgcggggatgacatggatccagacgccgtcaactacgggaaggaggaggcgagagttggagcgcgtgggagcgcagaggccggaggagggagggggggacaccgagcgcggagagcgcggagagcgcggagggaggcgcgcgcgggagcgaacaccctcccggatccagagcccggcggcggcgaagcagcagctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacgtaagtacagatggtgggagctgggcggttgcttcccagc

SEQ ID NO: 129724 - DNA, 195 bp, Homo sapiens; identical to SEQ ID NO: 41846
  misc_feature 1..195: note = chr8:91865364-91865559
  misc_feature 1..195: note = Hypo
  source 1..195: mol_type = genomic DNA

SEQ ID NO: 129725 - DNA, 38 bp, Homo sapiens; identical to SEQ ID NO: 99945
  misc_feature 1..38: note = chr8:91887415-91887453
  misc_feature 1..38: note = Hypo
  source 1..38: mol_type = genomic DNA

SEQ ID NO: 129726 - DNA, 1021 bp, Homo sapiens
  misc_feature 1..1021: note = chr8:91996985-91998006
  misc_feature 1..1021: note = Hyper
  source 1..1021: mol_type = genomic DNA
ttgaaagcctcccaccgcctggcaccaggtgctggggcagagccaaggggagctgtgtacttagctccttttttggcgatggctttggtctcggccacttgcccctccgtcgggctcccctggccccctacactttctttcccctcatccgacgctctcgctcccatcccactcccattcagggtccacagggtactgaaggggccctgagagatttcccgacccacctcagagcttctcttcctcgcctcaactttcccggggtcgggcctgggagacggcgcccacccgcctcctccacaccacggggcccgacttccgtcccccagtgtcgctcatcctccctagccacttaccgactcaaaatccacggggatttcggggcagcagcgtcgccgcgctcagcccacacgcggaggccgagcgccctgctgcccgtcggggaacggctcctgccgctggtccgctggctgaccgcggtggcggcggcggggggcgaggggcggggggcgaggggcggggggcggggcgggaggcggctccgaggggcacgaggcgggcccagggcgggcgcggggcgtggcctcgggcgctgagcctcgagagcagccgcacccctgccggggtagaaccgttaaaagggtggcgcgcgctttcccgggcgagctgggcgcgtggggttggagcggcgccacccagagccggtcgtctagggtaggaggccgcgagtgaggcgctgacaggctagccctcgacggggcgcgcccgcgtgaacggccttgggggccccagaccgtggccctgcttgtgcgaagactgggaggcgccaggcgggccgcctgctgggggcttggcggcgggttccaggcagcgtctgtgagggaggccgcctctgtgagggaggccgccgtcgtgctgacgactgagtccaccctactcctgtcccccgtcagagctgctggcaggcgctgctttccccttggtgcatttagtgggtgtcgggattcgggttggcagggag

SEQ ID NO: 129727 - DNA, 99 bp, Homo sapiens; identical to SEQ ID NO: 5080
  misc_feature 1..99: note = chr8:92083523-92083622
  misc_feature 1..99: note = Hypo
  source 1..99: mol_type = genomic DNA

SEQ ID NO: 129728 - DNA, 30 bp, Homo sapiens; identical to SEQ ID NO: 99949
  misc_feature 1..30: note = chr8:92982980-92983010
  misc_feature 1..30: note = Hypo
  source 1..30: mol_type = genomic DNA

SEQ ID NO: 129729 - DNA, 1194 bp, Homo sapiens
  misc_feature 1..1194: note = chr8:93113946-93115140
  misc_feature 1..1194: note = Hyper
  source 1..1194: mol_type = genomic DNA
tttccaagggttgaccgcccttacaaaaaataaaaaatagcacgtttcaaaaaatggatctgagcgccttgtgctgacctagccgtatttgctcaaagcaccccagtcagcgccaggtcccccccgggaaagaggtctgggtgcgccaaccaacccggtcctttcaggttcgcaaagagggcggtgagcggcgggccctggagcgcgtctccactggcccgggggcttcaccagaggggtttctggaaaacgaaaggaattatccggacgtggctccaagtctggaccccttcgggcgggagctacagggcacaaggttgtgctccccactcagaagaagcgggcaccgagtcggggccgcgacgggaacacccaggagggccggggcggctgagtccagagcgcgcagaggtcgggcggggacgactctccccatcggcccctgactgcgaagcccgggaccagcctcgggcgggagccgccgtccgcccgctcacccaggagcttcccagtccagcaccccaaacggccaggagtaacaaggaaagttcgcaggcaggcgcagagcgcctgggtacctctaagcaaacccccaccctagttgcagccgggtcccaaagttaagatcccgcctctttactccttagggctaagttttccaccatcaaaacaagtctttgcttccagtttacagaaaaagaaaagaaaaaaaaaaaaaagaaaggaaaagaaaaaaacccacgatgcgggcatagggccacctgccaaatgcactgtgggcacctcgatcggttgttttgtcgggggagaaacccactcgtcatcttcctgctcgcataccgtgactatggagagggaagaaaaattatttttaaaagacactgtggggaatataatagtaaaaactgcatcctcggctgacccgcgaagttcagtgtcatcgcagaccggagtcacccgcgatgttcctctttgccctggtgcgtagtcctaccctaattgagcgacaagtacagcctggagcctcgcggtcgaataatccaaacgaagatgacggtcatcggaacagtaattaataacagtcaggggcccgaccccgccgcccgcccgccggccaagccctaccgcggacacttacactgcacagggccggagagtcccaccatccgccacaggctccgagctgcaaataaa

SEQ ID NO: 129730 - DNA, 535 bp, Homo sapiens; identical to SEQ ID NO: 99953
  misc_feature 1..535: note = chr8:93115382-93115917
  misc_feature 1..535: note = Hyper
  source 1..535: mol_type = genomic DNA

SEQ ID NO: 129731 - DNA, 30 bp, Homo sapiens; identical to SEQ ID NO: 41848
  misc_feature 1..30: note = chr8:93449207-93449237
  misc_feature 1..30: note = Hypo
  source 1..30: mol_type = genomic DNA

SEQ ID NO: 129732 - DNA, 30 bp, Homo sapiens; identical to SEQ ID NO: 99955
  misc_feature 1..30: note = chr8:93509730-93509760
  misc_feature 1..30: note = Hypo
  source 1..30: mol_type = genomic DNA

SEQ ID NO: 129733 - DNA, 226 bp, Homo sapiens; identical to SEQ ID NO: 41849
  misc_feature 1..226: note = chr8:93848232-93848458
  misc_feature 1..226: note = Hypo
  source 1..226: mol_type = genomic DNA

SEQ ID NO: 129734 - DNA, 69 bp, Homo sapiens; identical to SEQ ID NO: 99957
  misc_feature 1..69: note = chr8:93978166-93978235
  misc_feature 1..69: note = Hyper
  source 1..69: mol_type = genomic DNA

SEQ ID NO: 129735 - DNA, 30 bp, Homo sapiens; identical to SEQ ID NO: 99958
  misc_feature 1..30: note = chr8:94237541-94237571
  misc_feature 1..30: note = Hypo
  source 1..30: mol_type = genomic DNA

SEQ ID NO: 129736 - DNA, 120 bp, Homo sapiens; identical to SEQ ID NO: 99959
  misc_feature 1..120: note = chr8:94684333-94684453
  misc_feature 1..120: note = Hypo
  source 1..120: mol_type = genomic DNA

SEQ ID NO: 129737 - DNA, 463 bp, Homo sapiens; identical to SEQ ID NO: 99960
  misc_feature 1..463: note = chr8:94712418-94712881
  misc_feature 1..463: note = Hyper
  source 1..463: mol_type = genomic DNA

SEQ ID NO: 129738 - DNA, 300 bp, Homo sapiens; identical to SEQ ID NO: 32151
  misc_feature 1..300: note = chr8:94713129-94713429
  misc_feature 1..300: note = Hyper
  source 1..300: mol_type = genomic DNA

SEQ ID NO: 129739 - DNA, 174 bp, Homo sapiens; identical to SEQ ID NO: 41850
  misc_feature 1..174: note = chr8:95211968-95212142
  misc_feature 1..174: note = Hypo
  source 1..174: mol_type = genomic DNA

SEQ ID NO: 129740 - DNA, 194 bp, Homo sapiens; identical to SEQ ID NO: 99963
  misc_feature 1..194: note = chr8:95212445-95212639
  misc_feature 1..194: note = Hypo
  source 1..194: mol_type = genomic DNA

SEQ ID NO: 129741 - DNA, 320 bp, Homo sapiens; identical to SEQ ID NO: 99964
  misc_feature 1..320: note = chr8:95246683-95247003
  misc_feature 1..320: note = Hyper
  source 1..320: mol_type = genomic DNA

SEQ ID NO: 129742 - DNA, 77 bp, Homo sapiens; identical to SEQ ID NO: 15137
  misc_feature 1..77: note = chr8:95416054-95416131
  misc_feature 1..77: note = Hypo
  source 1..77: mol_type = genomic DNA

SEQ ID NO: 129743 - DNA, 30 bp, Homo sapiens; identical to SEQ ID NO: 41852
  misc_feature 1..30: note = chr8:95622883-95622913
  misc_feature 1..30: note = Hypo
  source 1..30: mol_type = genomic DNA

SEQ ID NO: 129744 - DNA, 26 bp, Homo sapiens
  misc_feature 1..26: note = chr8:95650766-95650792
  misc_feature 1..26: note = Hypo
  source 1..26: mol_type = genomic DNA
gccaccgcgcccggcccagaaagatt

SEQ ID NO: 129745 - DNA, 183 bp, Homo sapiens; identical to SEQ ID NO: 99969
  misc_feature 1..183: note = chr8:95651327-95651510
  misc_feature 1..183: note = Hyper
  source 1..183: mol_type = genomic DNA

SEQ ID NO: 129746 - DNA, 119 bp, Homo sapiens; identical to SEQ ID NO: 99970
  misc_feature 1..119: note = chr8:95651726-95651845
  misc_feature 1..119: note = Hyper
  source 1..119: mol_type = genomic DNA

SEQ ID NO: 129747 - DNA, 172 bp, Homo sapiens; identical to SEQ ID NO: 99971
  misc_feature 1..172: note = chr8:95652419-95652591
  misc_feature 1..172: note = Hyper
  source 1..172: mol_type = genomic DNA

SEQ ID NO: 129748 - DNA, 49 bp, Homo sapiens; identical to SEQ ID NO: 99972
  misc_feature 1..49: note = chr8:95652814-95652863
  misc_feature 1..49: note = Hyper
  source 1..49: mol_type = genomic DNA

SEQ ID NO: 129749 - DNA, 109 bp, Homo sapiens; identical to SEQ ID NO: 99973
  misc_feature 1..109: note = chr8:95653342-95653451
  misc_feature 1..109: note = Hyper
  source 1..109: mol_type = genomic DNA

SEQ ID NO: 129750 - DNA, 321 bp, Homo sapiens; identical to SEQ ID NO: 99974
  misc_feature 1..321: note = chr8:95654016-95654337
  misc_feature 1..321: note = Hyper
  source 1..321: mol_type = genomic DNA

SEQ ID NO: 129751 - DNA, 27 bp, Homo sapiens
  misc_feature 1..27: note = chr8:95816428-95816455
  misc_feature 1..27: note = Hypo
  source 1..27: mol_type = genomic DNA
tcaaaaaattaaatgcgggccgggcgc

SEQ ID NO: 129752 - DNA, 21 bp, Homo sapiens
  misc_feature 1..21: note = chr8:95837385-95837406
  misc_feature 1..21: note = Hypo
  source 1..21: mol_type = genomic DNA
aaattacgtgctgggcgccgt

SEQ ID NO: 129753 - DNA, 21 bp, Homo sapiens
  misc_feature 1..21: note = chr8:95837646-95837667
  misc_feature 1..21: note = Hypo
  source 1..21: mol_type = genomic DNA
aagactcggaaaaaaaaaaaa

SEQ ID NO: 129754 - DNA, 30 bp, Homo sapiens; identical to SEQ ID NO: 99979
  misc_feature 1..30: note = chr8:95960767-95960797
  misc_feature 1..30: note = Hyper
  source 1..30: mol_type = genomic DNA

SEQ ID NO: 129755 - DNA, 28 bp, Homo sapiens
  misc_feature 1..28: note = chr8:96083320-96083348
  misc_feature 1..28: note = Hypo
  source 1..28: mol_type = genomic DNA
aaagcataaggcaaccggccgggcgcgg

SEQ ID NO: 129756 - DNA, 30 bp, Homo sapiens; identical to SEQ ID NO: 99981
  misc_feature 1..30: note = chr8:96125751-96125781
  misc_feature 1..30: note = Hypo
  source 1..30: mol_type = genomic DNA

SEQ ID NO: 129757 - DNA, 172 bp, Homo sapiens; identical to SEQ ID NO: 41856
  misc_feature 1..172: note = chr8:96208663-96208835
  misc_feature 1..172: note = Hypo
  source 1..172: mol_type = genomic DNA

SEQ ID NO: 129758 - DNA, 141 bp, Homo sapiens; identical to SEQ ID NO: 99983
  misc_feature 1..141: note = chr8:96219910-96220051
  misc_feature 1..141: note = Hypo
  source 1..141: mol_type = genomic DNA

SEQ ID NO: 129759 - DNA, 30 bp, Homo sapiens; identical to SEQ ID NO: 99985
  misc_feature 1..30: note = chr8:96314006-96314036
  misc_feature 1..30: note = Hypo
  source 1..30: mol_type = genomic DNA

SEQ ID NO: 129760 - DNA, 77 bp, Homo sapiens; identical to SEQ ID NO: 99987
  misc_feature 1..77: note = chr8:96837358-96837435
  misc_feature 1..77: note = Hypo
  source 1..77: mol_type = genomic DNA

SEQ ID NO: 129761 - DNA, 100 bp, Homo sapiens; identical to SEQ ID NO: 99988
  misc_feature 1..100: note = chr8:96849941-96850041
  misc_feature 1..100: note = Hypo
  source 1..100: mol_type = genomic DNA

SEQ ID NO: 129762 - DNA, 98 bp, Homo sapiens; identical to SEQ ID NO: 99990
  misc_feature 1..98: note = chr8:97039387-97039485
  misc_feature 1..98: note = Hypo
  source 1..98: mol_type = genomic DNA

SEQ ID NO: 129763 - DNA, 23 bp, Homo sapiens
  misc_feature 1..23: note = chr8:97095168-97095191
  misc_feature 1..23: note = Hypo
  source 1..23: mol_type = genomic DNA
gctgggcgtggagggcgtggtgg

SEQ ID NO: 129764 - DNA, 38 bp, Homo sapiens; identical to SEQ ID NO: 99992
  misc_feature 1..38: note = chr8:97145516-97145554
  misc_feature 1..38: note = Hyper
  source 1..38: mol_type = genomic DNA

SEQ ID NO: 129765 - DNA, 1191 bp, Homo sapiens
  misc_feature 1..1191: note = chr8:97156964-97158155
  misc_feature 1..1191: note = Hyper
  source 1..1191: mol_type = genomic DNA
ggtgggctccaggtgcgagcgcagcgggaagtcgcatacaccctcgcagtgataggcctcgtactccaggggcgcgataatccagtcgtcccagcccagctccttgaagttcacgtgcaggggcttcttgctgcagcgtagcctggacttcttgccgtgccgcttgccatggcgactggcgaaggccgtgcgccgccgccggcggccgggcgagggcagccaaggcctggcatccggggcgcccgacggcggcggccacgacccctcggcgcccgcgcccgggcccgcagcctcggccgagcccagctgctcgcgcatctctgcgaacaggttcttgcgctgggatctggtgaataccaccagcagggcccgctcctggggaggccgcaccctccggccgaagcccagactccgcaggtccgggggcggcggttgctggggtccccgcgcgcgcgcctcggcctccccggcgtccagctcgccccatgcggcccgcagctccaagcacagctgcttccagggctggtggcgcaggccctgccacacgtcgaagacttcccagccggccggcggcgccccctgcgggtccagggtccgcgcgtccagcagtaggggcgaaaggcaagggaagagctgcacgtggagcggcccggctggtggcccccagggcgctgagggcgcctggcgaaagagccgcagctccgcgcccaccagctcttctttgtctgagagcatggacacatcaaacaaatacttctgtctccggagaggagtgtgcgagagatcgtctgcgagataaaaaataattacagtcagtttcacttaagggggagatcagcccggtgctcttcggccgccccgggaggaaaagggcggggagtgggggcaggtcggccgggcagtccagcttgcccggcccagggcctgaccaccccggctccccatctggctggtgcatggcgcggggaagggggcgcgccaggacgggccccctccttcgcgtcagctccggactctcagggcggaagtcggtggctgctggcgaggcggcggcggcggcctaccgggttttccccccaaaaggcttcgtaaccactaatgtgccctttgtggtctcaagcctgggccgcgtttcccctagacctcctctgggctgggctggctcgttctcgttgacgtctcaaatgtcac

SEQ ID NO: 129766 - DNA, 511 bp, Homo sapiens; identical to SEQ ID NO: 99996
  misc_feature 1..511: note = chr8:97165624-97166135
  misc_feature 1..511: note = Hyper
  source 1..511: mol_type = genomic DNA

SEQ ID NO: 129767 - DNA, 91 bp, Homo sapiens; identical to SEQ ID NO: 99997
  misc_feature 1..91: note = chr8:97166425-97166516
  misc_feature 1..91: note = Hyper
  source 1..91: mol_type = genomic DNA

SEQ ID NO: 129768 - DNA, 30 bp, Homo sapiens; identical to SEQ ID NO: 99998
  misc_feature 1..30: note = chr8:97166873-97166903
  misc_feature 1..30: note = Hyper
  source 1..30: mol_type = genomic DNA

SEQ ID NO: 129769 - DNA, 45 bp, Homo sapiens; identical to SEQ ID NO: 32159
  misc_feature 1..45: note = chr8:97167178-97167223
  misc_feature 1..45: note = Hyper
  source 1..45: mol_type = genomic DNA

SEQ ID NO: 129770 - DNA, 4245 bp, Homo sapiens
  misc_feature 1..4245: note = chr8:97169648-97173893
  misc_feature 1..4245: note = Hyper
  source 1..4245: mol_type = genomic DNA
tgtacaggagcaagtcgcccatgcctcctggactgacttcggggctcctttccttttcttcgctcctccccttgggggacccccggctccaccgagccaggccagccccactcgacggcgatttaaacatcccttaggcaaggcgccaagttagcgctgctggcccagctctaggcgggccgctgctctttcctcctcgccaggccgtccacgcgttgggggaggggaccctaggggggttggcgcggttaagagccccacgtgagaggggcggaagtccttgccaggagccggggatgcgcggctggcgggtcccttccatcacgggagacgagacaccgtttgatgtgttatgacatgaaccctcaattagatcgctgagttgaaacactccaatcaggggcccgatgctaagcaagccccggaaggtccagcctgaggtcaccgccggtgacacatcaaatcaaaatcagtgagagggaaagtgaggctttccctttatcaagctggggctgcagccagcaacgcaccccctcctctgcgcacccctcccgcccgtggctccgcactccttcacccccgcgcggcgtgcgacaagccgcaccgccttcccagtcaacgaactgcctttcttcgcattttctgagaacccggagacgcggaggagacagcgcctttgaagatgctgtccgggtggtcatgcagcgtctcctcccgctgtggaccgctcgcatccccagccctccaccgcattccggggttgtagcggtacttgtggatctcggtcctgctagtctggaggccttggctcgggaacagaggcctccccagactgggtgcacatgcaatccctcctctatctccaggatcgggggcatacagcgcagtggcggggatgggggtggggaggctacagggcaaaccagggtaaagtgatttcgcgtctacgccggattggggcccccaagacttttccccaacccttgtctgaatgccacaggcttccggagacacctccgaacagcccgcagggtcttttggtcctgtgccaaattcacagggcgcagcgaaccagttatggtgcccacttgggggaggggcagagattcttgccacttcattcccgggcaaagaaaatccgcgcccaaccgccggccagcctaggcctctgggacttcttctcttgaggaagggcctcttgagcagtcttctctgagcttccttagcctccttccgcaattgtagtagagaaagtgcacgattaacagaggactttgagggacagaaacaactgtagcaaggcgtgcgtcgtggggagggttggcgagctgcacgggcagcacggaggccagggactcagttgcactactacgaagaagccacatgtctttgcaaaggtgactttagtagccctaaaatcatcataaaatacctggcgttaatttgccctctggacctttcagcagctcatgaacctcgctgacctcgggctgcagcggcgagaccctcgagcaaggaacgcgactatgagtgagaggcggggactggagccggggaagagctcggggctgggggcgggggggccgttagcctgctctaaaaagcttaagagatgtgcgagcacccagggtagcagtggctgaagcagcttccgaatcccgaaccccagcgctgcaaggtttccgggcaaccccacttaactgggagcaggtcaaagtcatggagctaagtctagggaggatggaggagtggatatctgcctaaatcgcttttatcccgtcattttcttccttccttctctttactcttcctttcctttttctcccttcctttcctgtctccttccacattattgtctctctcctttaggagcttagtttccgatgcctgtggatccttccctgatttctgggaccagaggtggtgcgaggttttcttgagggcactggccacgctgcagatcaacgccggtggcaagaaggggccgcaagggtttccgcagacacccacacatgcaggcgttcccacagagggtaccagggatttcccagacccccaccagccctcaggaatagcgtagagagaggaacgtcgcctggctgagaaaggtggatgggcatacccatgtacctttgtgtattaagtacccacaacctccgaacttagccgtccctgtcccggcccgcccaactgctgccgccgcatctgcagaaaccactcgtgttgaggcctcggagcagccgggagcaccacgctggagcaaaaaagccggagggcgcagggctccagcccggctgaccatcccacccagcgcagggaccaacggaaaacccgcgcggcgccaggaccagggggctgcccgacgccgctcgcggactagttcctcagactgtgggactccctagtgccggctttgcccagggctttccaaggctgtctcatgccctagatctgccccagcagctcaggccttggactgcgaacccagtatcccgagacaccgattccatcagtccccatcccgacccctctccagccgggttcatccgcctgctgcctcccgtcctccacgtttcccccaccagccaccaacaagcggcaaccacgctgccttctgcaaaagaggaagaaggaaagaagggagagagaaagaaagggggggaaaggaagggaggtttagagactggaatagaatccgcagccacattcagaaacttactcgagcttgagaaaaacaatttaagaaaagtaaaaaggaagtgtccagagcaggaagggaattcacaaatgtagcctccagcgggaacagctccctggctgccgagctccagcgggaggggagtcgagcgttttctttgccacttacctagtcccctgtctacaaagctggtgatcgtattagccgacttggaagactggaaaaagctggcattgatgcccagcttctcagcgatggagtaagtcctgtagattgacagcatgtactcgtggggcaccacgcgcggacccctgcctggcggctcctgcgcccggggctgctgagcccggggttcgtcctgaggccgcggctgtggttcctggccctcccggcccgcgtcactgtcgcgcggcgcccgctgcatcttgccttccttgcggcttcgcatgcccttggtggaacccagctcggcggacgacgaggaggatgagatggaagcctgctggaaaccgggcaaatcccacagaaaactgatgaggaagacggccgagagcaggaccctgggagtatccatggcgggcaagtggctgcgtctccccaggaggcggtggcggcggcgcaggacgcgcggggcacggagcggctggacagcggccggggcccggctcctcgggcggactcggagtgcgaggagccgggtcccagccacacaaaccccggccccgccacgccccctcccgcccctcgccgggaggggaggaatggggagggagggcagaggaggggtggggagggtgggaggagagccgggtggtgcgggccggaggtgtgggggagaggggccgcggtgcgccggtgtggcaggaagacgcagcgcccccgcgggacgcgcgcggggttgccgggcggtgcgcgcggcgcgggccgcaagcgctgaccgggggaaggcgggcgctgccggcccgtggccggggagcaaaggctggcccgccgcgccagggtccccctcgaactcccggaggtgtggtccctccgcagcgcggccccggctctcggtcctcgccagccgcctccactttcctgggagcgagcggccccggaggagggaagcggcggcggcgcccccaagagacagcttggagcaggcgcctctgctgcaggctgcgtgctgcctcggggcggtggtaccctccctcctcggccccaaccgccaggcctgccgtttgcgcccctcaggggccagcccggagccagagaagcctcgccctgggccaggcgcagggcccagctcggaacagccccattttctcggttgggtatcgctctccacaaagacaggcgtctattcccgaccctcgaggtcaggcaaaggccacgagtctttagagtttggatcgatgctaaaagctgctgcgctcccctgcaggccccagcctctcctctcgcagtccccaacctcttctgacgcagactttagctgctccacttcttcgtctgctcccgggatcctctccctctcgcggcctgccccccgcctccactgcatc

SEQ ID NO: 129771 - DNA, 29 bp, Homo sapiens
  misc_feature 1..29: note = chr8:97272421-97272450
  misc_feature 1..29: note = Hypo
  source 1..29: mol_type = genomic DNA
ctcggcccattctgcgatgattttagaaa

SEQ ID NO: 129772 - DNA, 497 bp, Homo sapiens; identical to SEQ ID NO: 100013
  misc_feature 1..497: note = chr8:97339742-97340239
  misc_feature 1..497: note = Hypo
  source 1..497: mol_type = genomic DNA

SEQ ID NO: 129773 - DNA, 2150 bp, Homo sapiens
  misc_feature 1..2150: note = chr8:97505578-97507728
  misc_feature 1..2150: note = Hyper
  source 1..2150: mol_type = genomic DNA
agaaaagctacatacgtctctcgtttcttcactaattgttctctagaaaagggaaagtgaagaagggaaagagaaaagacaacggggaagaaaagagcatagaggagagaggaaaagtggggagagaaaggaagaaaaggactgagaaaacgcaggagccctggcttgccggtgagcagagccggcgcagccacagcgcggagccgcggcgcccactggtcctcggagctgccaatcggcgtgtaatcctgtaggaatttctcccgggtttatctgggagtcacactgccgcctcctctccccagtcgcccaggggagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcggtgagtgggccaggcggaggatgcgcgcgccgtttagggtgtttgaagctacgagaggagcccgcagggaataggggagcgccacctggggaacccccagtccccaagtatacaccggagatccgctgggacaaatgcgctcgtccggtcaccctttccccctcttcccttcctcagaaaagcgctgctcgctggcgttaccccgcggtccgcgggaatgggggcaccgagaattgcggtttggtctagccgcagaggcccctgaagtcactcccaacttcttcgccctcggcgggtcttgctgcgtggtctgggaaggacggaggggaaagggtggcaggaggggggagcctgggtcgggcccgcgagggaacggctccactccgcgcgctcctcgagaccagggatgacctggaaacttcggggtcccttcctccgcacaccatcccccccgcgccagctttcctgtttgactgcatgcaagttctggggagatgggggccagatttaagagacccgcgagtgtccagagagaaaagtttgcaaaagttcttttgtttgatgctccctgcggctagggcgaggtaaccgacactacgtggaatcgcagtaggcgatccctcaaggggatactgggggaggcacggaacgcgtccgaaaatgctgggacgccggccactggattcccagtcctgcggcgaccccctcctcgttgaggggtggaggttgcaccgcggggcgtcagggacgggaggacattttcataggagttacacgggagtgccgcaagcagggcgaggcggggtacgtgtgacacggcgctcggcttcgggtcgcctggccgctgggggacagaggcttccctcccgccacgctcgccctctctggccctggcggggcgcttctggggccgggaggagtctcgtctccggcggagcgcctgccggcacccagcttccctcccccgccctggcggtgggaacttgatttctccttttggtcgcgcttcgggggctggagcttgtttccccacgtcgcccaatgagcgccctctaaagggaactgcctccttggcctcctctcgtccgcagctgcctccacctgggcgccaggagctctgtcgggccaggtggaagcttgagcaccccagatttcgtctgcagcctcag

SEQ ID NO: 129774 - DNA, 321 bp, Homo sapiens; identical to SEQ ID NO: 100030
  misc_feature 1..321: note = chr8:97657790-97658111
  misc_feature 1..321: note = Hyper
  source 1..321: mol_type = genomic DNA

SEQ ID NO: 129775 - DNA, 32 bp, Homo sapiens; identical to SEQ ID NO: 100032
  misc_feature 1..32: note = chr8:97819738-97819770
  misc_feature 1..32: note = Hypo
  source 1..32: mol_type = genomic DNA

SEQ ID NO: 129776 - DNA, 163 bp, Homo sapiens; identical to SEQ ID NO: 100033
  misc_feature 1..163: note = chr8:97982654-97982817
  misc_feature 1..163: note = Hypo
  source 1..163: mol_type = genomic DNA

SEQ ID NO: 129777 - DNA, 43 bp, Homo sapiens; identical to SEQ ID NO: 100034
  misc_feature 1..43: note = chr8:97983057-97983100
  misc_feature 1..43: note = Hypo
  source 1..43: mol_type = genomic DNA

SEQ ID NO: 129778 - DNA, 568 bp, Homo sapiens
  misc_feature 1..568: note = chr8:98289818-98290386
  misc_feature 1..568: note = Hyper
  source 1..568: mol_type = genomic DNA
cagtccagggggagccggcaggcggcctcctccccgagccggaggagctgcgcggacgcagcggcttccaggccaccccaccccgcgccagcctgcacctgtgccgcctgggtgtcttccccgagactctggtactgtgaagggtccgggtcgcgcggggcgtcgtccggagcagggcggactcgggctttggcgcggcctttgccccggtttttggcgcgggaggactttcgaccccgacttcggccgctcatggtggcggcggaggcagcttcaaagacacgctgtgaccctgcggctcctgacgccagctctcggtcgggaccgagcgggtctctccacggcaaccgccgacgtcacgaacgtacaactgtaccgtcgcgagaggacgtgatgcgcccggtgattggcgccgccgctgcggctgcgcaggagacgacccccgcgggcgctcccacccccatctcgcgcggactcgctttaggtctcggcgagtttctctgatatgcgctcgcgggggtgctgccatttcatctcttccgcgcgggctcatcgtgctctcagggtc

SEQ ID NO: 129779 - DNA, 30 bp, Homo sapiens; identical to SEQ ID NO: 100037
  misc_feature 1..30: note = chr8:98307773-98307803
  misc_feature 1..30: note = Hypo
  source 1..30: mol_type = genomic DNA

SEQ ID NO: 129780 - DNA, 34 bp, Homo sapiens; identical to SEQ ID NO: 100038
  misc_feature 1..34: note = chr8:98404798-98404832
  misc_feature 1..34: note = Hypo
  source 1..34: mol_type = genomic DNA

SEQ ID NO: 129781 - DNA, 30 bp, Homo sapiens; identical to SEQ ID NO: 15140
  misc_feature 1..30: note = chr8:98738336-98738366
  misc_feature 1..30: note = Hypo
  source 1..30: mol_type = genomic DNA

SEQ ID NO: 129782 - DNA, 39 bp, Homo sapiens; identical to SEQ ID NO: 100041
  misc_feature 1..39: note = chr8:98748495-98748534
  misc_feature 1..39: note = Hypo
  source 1..39: mol_type = genomic DNA

SEQ ID NO: 129783 - DNA, 28 bp, Homo sapiens
  misc_feature 1..28: note = chr8:98787775-98787803
  misc_feature 1..28: note = Hyper
  source 1..28: mol_type = genomic DNA
aagggaagaaaatcgcaaggaactagac

SEQ ID NO: 129784 - DNA, 152 bp, Homo sapiens; identical to SEQ ID NO: 100043
  misc_feature 1..152: note = chr8:98788285-98788437
  misc_feature 1..152: note = Hyper
  source 1..152: mol_type = genomic DNA

SEQ ID NO: 129785 - DNA, 213 bp, Homo sapiens; identical to SEQ ID NO: 100044
  misc_feature 1..213: note = chr8:98788792-98789005
  misc_feature 1..213: note = Hyper
  source 1..213: mol_type = genomic DNA

SEQ ID NO: 129786 - DNA, 30 bp, Homo sapiens; identical to SEQ ID NO: 100045
  misc_feature 1..30: note = chr8:98881022-98881052
  misc_feature 1..30: note = Hyper
  source 1..30: mol_type = genomic DNA

SEQ ID NO: 129787 - DNA, 67 bp, Homo sapiens; identical to SEQ ID NO: 100046
  misc_feature 1..67: note = chr8:98881817-98881884
  misc_feature 1..67: note = Hyper
  source 1..67: mol_type = genomic DNA

SEQ ID NO: 129788 - DNA, 705 bp, Homo sapiens
  misc_feature 1..705: note = chr8:99076589-99077294
  misc_feature 1..705: note = Hyper
  source 1..705: mol_type = genomic DNA
tgccataccctccaccgtctcccctcctgtctcctgggctctactcctccctgccctcctctgcgtcctggccctcccgctctcttccgctttgcgctcccaggctccttccacctcctgccagctcccttcctcctccaggtgcgcaccccctaccattagccccgctgcgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcggtgagcagggtaccggcgccgcccgcgcccgggctggggactcgggtgggctaactccccaggaggtccaaagggtgtgtcccgtggccaccccgcctggcaggagccgggccttgtcccggaggatgcgagcagaacccgggacaaagcgcgatttccttccaaatctggagcggcgctgctgtgaccgcgggtgcggcggccctggtgcgctccgcggcgctcgctgcgagacgcgcggggcccgaggccgggcgctggattcaccctgtccgctgatgggatctcggggagttggtgttgaggccctaaggcggttagcctcggcattgccttaaa

SEQ ID NO: 129789 - DNA, 78 bp, Homo sapiens; identical to SEQ ID NO: 100049
  misc_feature 1..78: note = chr8:99130933-99131011
  misc_feature 1..78: note = Hypo
  source 1..78: mol_type = genomic DNA

SEQ ID NO: 129790 - DNA, 1564 bp, Homo sapiens; identical to SEQ ID NO: 100050
  misc_feature 1..1564: note = chr8:99438813-99440377
  misc_feature 1..1564: note = Hyper
  source 1..1564: mol_type = genomic DNA

SEQ ID NO: 129791 - DNA, 224 bp, Homo sapiens; identical to SEQ ID NO: 100052
  misc_feature 1..224: note = chr8:99950717-99950941
  misc_feature 1..224: note = Hyper
  source 1..224: mol_type = genomic DNA

SEQ ID NO: 129792 - DNA, 110 bp, Homo sapiens; identical to SEQ ID NO: 100053
  misc_feature 1..110: note = chr8:99951392-99951502
  misc_feature 1..110: note = Hyper
  source 1..110: mol_type = genomic DNA

SEQ ID NO: 129793 - DNA, 1340 bp, Homo sapiens
  misc_feature 1..1340: note = chr8:99951797-99953137
  misc_feature 1..1340: note = Hyper
  source 1..1340: mol_type = genomic DNA
aaacaagtctggagacgggagggtagcgctgctcagctccagccaactcactgccgcgtaggaacggaggtcatcggaaatcaagatttccgtttgaattttcccaaagtttaagcgttggcaagtgcgttgaaaaacacacacaatatgaaagcctaataaaaatataggtttgcagaccgtgccctagtcttttccgaggatgttcttttctgtcatccatcgtctacccacgttgagcacgacagccgggccagtcccgccctgggcggttggggccttcccagaggggcccggtgcggagagcccccctctccccggatgtgtctggggcctgtccttcactgcgatgtcatcggtaaacctggtcttccttgtcacggacactgaagcgcttggttcgaaaagcaccatgaattcgaagcagccttggacgcgggatcatgggcgttagcctggctctctccgacgaggcaaactgcaggagatccccttccctggagtcaccggaaggcgaaagcacgctctgtgcccgcgcgccgccccgggagcccgctcctaccccctcggcgtgcggcgcgggcctggagaccgcggagcccgagccgtatccagcttgtgcaggagccggtgcgcccttccgcccgctcctcccccgggaccatcctcacgctccagggtcgcggaggcatcttgcgactagcgaggggctgacggtggcctgggtggccttgcgccggctctgggctccgccgctgcggcagccgagggcctcagctgggaaatccaaacccgggctggacctgggctcaaggaggtttctgtccccaggctagaccaccacggccacggccacgcaacttgccctgagaccccgtgctcggccttcccactgagctccccttccctgtgactcagtgcctcgcaggctggtggccggaagggtgcctgcggctggctggcccggcccgattccgggtggcggggttcctgcagtgaggaacgaccctcagctcccgcagacgcgggaaggcccccgcgccatccgtgggagtggggcagcctgtctgcacgcggtcccctgggaaacccctctgcatctcccgcccggacaaggtccccggccttggaatctgcgccgccccgcacgcgaccgcctgcgaactccctgcgctggggtcagaactggtatctttctcctcctctggggaagtcagggcagcccggagtggcgtcgtgggtccgaaaaatccgtctcagaaacccaccaggagaaaaggctctggggtgggggacaccatgtggggctcccacaaaggacccgacggtgggtgtggaga

SEQ ID NO: 129794 - DNA, 606 bp, Homo sapiens
  misc_feature 1..606: note = chr8:99954156-99954762
  misc_feature 1..606: note = Hyper
  source 1..606: mol_type = genomic DNA
gcggcaggaatggaacggctccgcggagacagcctcgggggcacagccgggccactgcagactccgggacttccctctccgcacacccgaaacccacaactcgcccgtgggccgcgtggcctttctgcgccgagggctgctgggggcgggcggcgagcctggcgggtgacctgctcttgggtgggccccgcaatgcctgcgccctagacgccggccgggacgaggggctggctgggtctgagcctggagaaacacaagggtcagcccccagtgggcgcagaggtggcccaggagggcccgcggacggtgctgcgctgcgctcagcctccgggccgctccccgcgttcggcgcgcacctgcccatcgaggcggcagggccagcaggcggcctaggcgcggccgggccacgcggcatcccccaaagctggagctcgccgactcttccctaccttttcaagagaccgtagtcgtgcccagaacgccggcgtggcccagactccattttggaacttcgcaggctggcgtggacgaagtaaacacatttatggaaaaaccccggggttaggaggtttgcggaaagagggagcagctcgtggggttggaaat

SEQ ID NO: 129795 - DNA, 128 bp, Homo sapiens; identical to SEQ ID NO: 100060
  misc_feature 1..128: note = chr8:99955180-99955308
  misc_feature 1..128: note = Hyper
  source 1..128: mol_type = genomic DNA

SEQ ID NO: 129796 - DNA, 50 bp, Homo sapiens; identical to SEQ ID NO: 100061
  misc_feature 1..50: note = chr8:99955973-99956023
  misc_feature 1..50: note = Hyper
  source 1..50: mol_type = genomic DNA

SEQ ID NO: 129797 - DNA, 423 bp, Homo sapiens; identical to SEQ ID NO: 100062
  misc_feature 1..423: note = chr8:99957286-99957709
  misc_feature 1..423: note = Hyper
  source 1..423: mol_type = genomic DNA

SEQ ID NO: 129798 - DNA, 2169 bp, Homo sapiens
  misc_feature 1..2169: note = chr8:99960048-99962217
  misc_feature 1..2169: note = Hyper
  source 1..2169: mol_type = genomic DNA
tttcctctccctccccggagcgctctcctctctcctctcccctctcttctctctcctctctcgtctcctggggcatcccgggtggagggatgtaggggtcgctcctcggtgccaggccgggaagcagctcaggcctcccaagagcttggcgctcagtctgggaaaaggggttcctctggcctcagggacgttctccgcccccaccccaccccctgggagcctgaaccatctggaagggatcttagtcgggggttgggaggagagcccgtggataggaggagggggcgattctaggccgaatccagcccctgaggtgtcacttttctttcctgcggcccgtcaccgctgatagatggggctgagggcagaggaaggaaaaagaaaacctccgaggtcagtgcggggcgaggtgagcccctcccagggccctctggcccaggaggatgaagcgcgccggcttcgctcttgcacgccggcttgccatccgggtaagcgcgggaaaggcggccacagggcgcggcggcagcgcagcgcgtgggatctcacgacccatccgttaacccaccgttcccaggagctccgaggcgcagcggcgacagaggttcgccccggcctgctagcattggcattgcggttgactgagcttcgcctaacaggcttggggagggtgggctgggctgggctgggctgggctgggtgctgcccggctgtccgcctttcgttttcctgggaccgaggagtcttccgctccgtatctgcctagagtctgaatccgactttctttcctttgggcacgcgctcgccagtggagcacttcttgttctggccccgggctgatctgcacgcggacttgagcaggtgccaaggtgccacgcagtcccctcacggctttcggggggtcttggagtcgggtggggagggagacttaggtgtggtaacctgcgcaggtgccaaagggcagaaggagcagccttggattatagtcacggtctctccctctcttccctgccatttttagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacaggtgaggcgggcaaggaggatggctgggagagggaaagcgaatttgtcctggacacaccgagtcctgatagacattcccagtgtcattataatcccctgtgatctaaaatacaccctcagtcacgctcctcagcccggttcagctaattcccaacatctaccctttctttcccccagcggctcttgctacgttcttgtttggaatgagggagggcctttcctcagtcttggacaggaacaatctgttggccttagtcctgggatggttatcctgtctcctcccggtgctgtggggagtggtgcaggcagaacccaggtaccctggggtgccggtcctggctgcagtcgggctacttctgttgggtttcgtccctccccccac

SEQ ID NO: 129799 - DNA, 274 bp, Homo sapiens; identical to SEQ ID NO: 100066
  misc_feature 1..274: note = chr8:99963588-99963862
  misc_feature 1..274: note = Hyper
  source 1..274: mol_type = genomic DNA

SEQ ID NO: 129800 - DNA, 1175 bp, Homo sapiens
  misc_feature 1..1175: note = chr8:99985845-99987020
  misc_feature 1..1175: note = Hyper
  source 1..1175: mol_type = genomic DNA
ggcctaggcctagttcgtgtccatgaagcctctccacgtggccgacttcccttagagaagtcccacaagccctcagccctcacagcctcgcccgcgacgccgtgcccacccctcccctggcagccccgagactctgggcgtgtgcttcccgctccccgagggccttaggcccagcggacgcccggccggagcctgatgccggcggcctccccctccctcagcgaggcacgcgcgtccccaggaccgccggtgccggggcctttaaccctggccgccgacgccgcggggaaaggaagcttctgcggctacagatggcgcaggccccaggtcgcagagaagccctatccaactctgcggactggccctgggagaaagggcccgggagttgcttctccagtcggtgaacgctccgttgagccacgtctatgcgcttgctcatggataagcgcactgggggactatactgcagtgtgaccgccagtgtccccagggaggctgcggaaaagtagaggcaatgagacccgagcagaaatagggacttctcgcggcagtccgcacggaagcagctggggagcatccagctcgaccctccccacaggcccagggtcgggacaccgagggaaggcgcggcgcgcgcggcaaggccaggggcgcggggctgggctcggccggcacaagtgctcggaccgcggagcgtcctcggtgaggcgttcggtatggattgggtaggagcggccctgggcgatgggcctgacgtcggtgggcgcagttgaggccactgcaaggccgctggatcccggatccgcacccgagacggagcgggggccacacgggataaccgagggggcgaacgggagtttcgggcctccgctccctctccgggtgggggacaggtcgccgagtccgaggtcgggcgcgaaggccactcgcattttcccgccttccgcgagcaacccaggggccctgcgggaggaggagagggtcccgggagtccgcccttccctgcgccttcgggaccggcaggaggcgctgcgcgggcgaattaaaagaaaaggaaaagctcgtagtggaggtgttaccgcatcctgcctttggacgctactcttagttgagtgacccgattcggaccttaggggcgttagggtctcctccaccgcctccctcccctgttaaaa

SEQ ID NO: 129801 - DNA, 94 bp, Homo sapiens; identical to SEQ ID NO: 100070
  misc_feature 1..94: note = chr8:99987080-99987174
  misc_feature 1..94: note = Hyper
  source 1..94: mol_type = genomic DNA

SEQ ID NO: 129802 - DNA, 154 bp, Homo sapiens; identical to SEQ ID NO: 98317
  misc_feature 1..154: note = chr8:100026613-100026767
  misc_feature 1..154: note = Hypo
  source 1..154: mol_type = genomic DNA

SEQ ID NO: 129803 - DNA, 36 bp, Homo sapiens; identical to SEQ ID NO: 41867
  misc_feature 1..36: note = chr8:100245127-100245163
  misc_feature 1..36: note = Hypo
  source 1..36: mol_type = genomic DNA

SEQ ID NO: 129804 - DNA, 101 bp, Homo sapiens; identical to SEQ ID NO: 98323
  misc_feature 1..101: note = chr8:100359726-100359827
  misc_feature 1..101: note = Hypo
  source 1..101: mol_type = genomic DNA

SEQ ID NO: 129805 - DNA, 145 bp, Homo sapiens; identical to SEQ ID NO: 98324
  misc_feature 1..145: note = chr8:100519073-100519218
  misc_feature 1..145: note = Hypo
  source 1..145: mol_type = genomic DNA

SEQ ID NO: 129806 - DNA, 103 bp, Homo sapiens; identical to SEQ ID NO: 41869
  misc_feature 1..103: note = chr8:100904181-100904284
  misc_feature 1..103: note = Hypo
  source 1..103: mol_type = genomic DNA

SEQ ID NO: 129807 - DNA, 216 bp, Homo sapiens; identical to SEQ ID NO: 41870
  misc_feature 1..216: note = chr8:100906569-100906785
  misc_feature 1..216: note = Hypo
  source 1..216: mol_type = genomic DNA

SEQ ID NO: 129808 - DNA, 29 bp, Homo sapiens
  misc_feature 1..29: note = chr8:100961902-100961931
  misc_feature 1..29: note = Hypo
  source 1..29: mol_type = genomic DNA
cctaaagatttcttcgtacatagtaaact

SEQ ID NO: 129809 - DNA, 639 bp, Homo sapiens
  misc_feature 1..639: note = chr8:101118005-101118644
  misc_feature 1..639: note = Hyper
  source 1..639: mol_type = genomic DNA
tctcatgtctgggagcggggataccgctaggagggcaggaggtaaagtccagaggctggcgcgtggtgcggccccgacgccgcgggctgatcctctgtccctgtggggccgccacctacccgcggtgagcctcttctcgggcatgccgtccccgctgcccgcgcctggagcccgcgcgggccgtcagggccctagcgcgcgggtccagcgcgggtcagggcctgagcgacgcggcgacggcgcgcgggctccggagctacgctggctagcgtggccggcgccgcgccggggttgctatggagcttagacaatacggccgcccagggaggccgaggccggccactcaggtgcctttcggggttcccaagctgcgacgggaacacccccgccgccccctaccctcccttcctcctcctctgggcagggaccagcgcggcgaacgaaggctgggggcggacgcgcgtgtggacccccagcgcggtcacccggaaggggcgccctggagacgcctgtgtccctcgagactccactggcagcgaattcgttactgtggtgaccgctgctcaggtccgttattcctccactacagcccgccagcaacggccagggaaacgcggtgctccacgggagggagaggcc

SEQ ID NO: 129810 - DNA, 150 bp, Homo sapiens; identical to SEQ ID NO: 41871
  misc_feature 1..150: note = chr8:101156747-101156897
  misc_feature 1..150: note = Hypo
  source 1..150: mol_type = genomic DNA

SEQ ID NO: 129811 - DNA, 48 bp, Homo sapiens; identical to SEQ ID NO: 98331
  misc_feature 1..48: note = chr8:101158248-101158296
  misc_feature 1..48: note = Hyper
  source 1..48: mol_type = genomic DNA

SEQ ID NO: 129812 - DNA, 23 bp, Homo sapiens
  misc_feature 1..23: note = chr8:101241341-101241364
  misc_feature 1..23: note = Hypo
  source 1..23: mol_type = genomic DNA
aatgaggaagtaggccgggcgtg

SEQ ID NO: 129813 - DNA, 39 bp, Homo sapiens; identical to SEQ ID NO: 98333
  misc_feature 1..39: note = chr8:101257404-101257443
  misc_feature 1..39: note = Hypo
  source 1..39: mol_type = genomic DNA

SEQ ID NO: 129814 - DNA, 30 bp, Homo sapiens; identical to SEQ ID NO: 41873
  misc_feature 1..30: note = chr8:101299821-101299851
  misc_feature 1..30: note = Hypo
  source 1..30: mol_type = genomic DNA

SEQ ID NO: 129815 - DNA, 30 bp, Homo sapiens; identical to SEQ ID NO: 98335
  misc_feature 1..30: note = chr8:101300280-101300310
  misc_feature 1..30: note = Hypo
  source 1..30: mol_type = genomic DNA

SEQ ID NO: 129816 - DNA, 30 bp, Homo sapiens; identical to SEQ ID NO: 98336
  misc_feature 1..30: note = chr8:101428824-101428854
  misc_feature 1..30: note = Hypo
  source 1..30: mol_type = genomic DNA

SEQ ID NO: 129817 - DNA, 30 bp, Homo sapiens; identical to SEQ ID NO: 41874
  misc_feature 1..30: note = chr8:101438141-101438171
  misc_feature 1..30: note = Hypo
  source 1..30: mol_type = genomic DNA

SEQ ID NO: 129818 - DNA, 79 bp, Homo sapiens; identical to SEQ ID NO: 32204
  misc_feature 1..79: note = chr8:101661840-101661919
  misc_feature 1..79: note = Hyper
  source 1..79: mol_type = genomic DNA

SEQ ID NO: 129819 - DNA, 274 bp, Homo sapiens; identical to SEQ ID NO: 98339
  misc_feature 1..274: note = chr8:101693763-101694037
  misc_feature 1..274: note = Hypo
  source 1..274: mol_type = genomic DNA

SEQ ID NO: 129820 - DNA, 30 bp, Homo sapiens; identical to SEQ ID NO: 41876
  misc_feature 1..30: note = chr8:101717092-101717122
  misc_feature 1..30: note = Hypo
  source 1..30: mol_type = genomic DNA

SEQ ID NO: 129821 - DNA, 36 bp, Homo sapiens; identical to SEQ ID NO: 98341
  misc_feature 1..36: note = chr8:101726909-101726945
  misc_feature 1..36: note = Hypo
  source 1..36: mol_type = genomic DNA

SEQ ID NO: 129822 - DNA, 42 bp, Homo sapiens; identical to SEQ ID NO: 41877
  misc_feature 1..42: note = chr8:101729504-101729546
  misc_feature 1..42: note = Hypo
  source 1..42: mol_type = genomic DNA

SEQ ID NO: 129823 - DNA, 40 bp, Homo sapiens; identical to SEQ ID NO: 98343
  misc_feature 1..40: note = chr8:101736275-101736315
  misc_feature 1..40: note = Hypo
  source 1..40: mol_type = genomic DNA

SEQ ID NO: 129824 - DNA, 27 bp, Homo sapiens
  misc_feature 1..27: note = chr8:101766351-101766378
  misc_feature 1..27: note = Hypo
  source 1..27: mol_type = genomic DNA
cctcaagcgatccgcctcagcctctct

SEQ ID NO: 129825 - DNA, 173 bp, Homo sapiens; identical to SEQ ID NO: 32205
  misc_feature 1..173: note = chr8:101821973-101822146
  misc_feature 1..173: note = Hyper
  source 1..173: mol_type = genomic DNA

SEQ ID NO: 129826 - DNA, 140 bp, Homo sapiens; identical to SEQ ID NO: 98346
  misc_feature 1..140: note = chr8:101872139-101872279
  misc_feature 1..140: note = Hypo
  source 1..140: mol_type = genomic DNA

SEQ ID NO: 129827 - DNA, 68 bp, Homo sapiens; identical to SEQ ID NO: 98348
  misc_feature 1..68: note = chr8:102039492-102039560
  misc_feature 1..68: note = Hypo
  source 1..68: mol_type = genomic DNA

SEQ ID NO: 129828 - DNA, 153 bp, Homo sapiens; identical to SEQ ID NO: 98349
  misc_feature 1..153: note = chr8:102092984-102093137
  misc_feature 1..153: note = Hyper
  source 1..153: mol_type = genomic DNA

SEQ ID NO: 129829 - DNA, 213 bp, Homo sapiens; identical to SEQ ID NO: 41880
  misc_feature 1..213: note = chr8:102155655-102155868
  misc_feature 1..213: note = Hypo
  source 1..213: mol_type = genomic DNA

SEQ ID NO: 129830 - DNA, 32 bp, Homo sapiens; identical to SEQ ID NO: 98355
  misc_feature 1..32: note = chr8:102504728-102504760
  misc_feature 1..32: note = Hyper
  source 1..32: mol_type = genomic DNA

SEQ ID NO: 129831 - DNA, 554 bp, Homo sapiens
  misc_feature 1..554: note = chr8:102505540-102506094
  misc_feature 1..554: note = Hyper
  source 1..554: mol_type = genomic DNA
gtgggcgtgagtgcgcgcccgcgtgtggccccgatgggaggcgaggcgctgggaggccggggggcgcgggggcggccggcgccgtcccccactccctcgacatcccgccttcctcccccctcccccgcctccctcccccgggtccgcccccgcattgtttggccaccttcctcaggtgcccggggggaaaggacggttcgcgaactgggggaactcatgtgaggcctcgagttagggcctcggcggggcgcgaaggggcgcctgccactgagcgattcacccgcgcccccgacggcgtctgcacgcccctcgagctcgcggccctccacgcagttggccgccacctcggacgcggcaggcgggactgcgtggggcgcgccgagccttctcggggtgctctcgccgtcaaggccgagggctcggggcggcgggaacgctgggctcgcgtccttcccgtcccggacaggcactccagacgcgtcggggagccacagcctgcgcggccggagccgcccgcgggtcactgggcccggtccggccgcgtcctgacggcc

SEQ ID NO: 129832 - DNA, 38 bp, Homo sapiens; identical to SEQ ID NO: 98357
  misc_feature 1..38: note = chr8:102506405-102506443
  misc_feature 1..38: note = Hyper
  source 1..38: mol_type = genomic DNA

SEQ ID NO: 129833 - DNA, 30 bp, Homo sapiens; identical to SEQ ID NO: 98358
  misc_feature 1..30: note = chr8:102517511-102517541
  misc_feature 1..30: note = Hypo
  source 1..30: mol_type = genomic DNA

SEQ ID NO: 129834 - DNA, 624 bp, Homo sapiens; identical to SEQ ID NO: 98360
  misc_feature 1..624: note = chr8:103135899-103136523
  misc_feature 1..624: note = Hyper
  source 1..624: mol_type = genomic DNA

SEQ ID NO: 129835 - DNA, 30 bp, Homo sapiens; identical to SEQ ID NO: 41881
  misc_feature 1..30: note = chr8:103403324-103403354
  misc_feature 1..30: note = Hypo
  source 1..30: mol_type = genomic DNA

SEQ ID NO: 129836 - DNA, 90 bp, Homo sapiens; identical to SEQ ID NO: 98362
  misc_feature 1..90: note = chr8:103613211-103613301
  misc_feature 1..90: note = Hyper
  source 1..90: mol_type = genomic DNA

SEQ ID NO: 129837 - DNA, 94 bp, Homo sapiens; identical to SEQ ID NO: 98363
  misc_feature 1..94: note = chr8:103618015-103618109
  misc_feature 1..94: note = Hypo
  source 1..94: mol_type = genomic DNA

SEQ ID NO: 129838 - DNA, 41 bp, Homo sapiens; identical to SEQ ID NO: 41882
  misc_feature 1..41: note = chr8:103629841-103629882
  misc_feature 1..41: note = Hypo
  source 1..41: mol_type = genomic DNA

SEQ ID NO: 129839 - DNA, 214 bp, Homo sapiens; identical to SEQ ID NO: 98365
  misc_feature 1..214: note = chr8:103768734-103768948
  misc_feature 1..214: note = Hypo
  source 1..214: mol_type = genomic DNA

SEQ ID NO: 129840 - DNA, 985 bp, Homo sapiens
  misc_feature 1..985: note = chr8:104152711-104153696
  misc_feature 1..985: note = Hyper
  source 1..985: mol_type = genomic DNA
gccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggtaagtggccgggcccctgcagaccctcgcccgcccgctaccccgggcgccttggcccgggcactgagagaggagccggttccctgaggaattgatggcgcggcgggggtggctgggaggaagcagaggcaggacctgcccactgatcagtggacagatgcaagcccagggagtggggtcgaccagagccccttaccgaaggctgcgccgatgccccagcttccagcagcccaatgctctttggccttgtccaaagcttgctcgctggtcgggagaccggtgggtgggaggacagcccacctcctccgcacacatatccctcagccacccaccccctgatccgcccagggccgcctccgccccgctttggcccatctgccatcccctggccacctgcgtacccagccgggt

SEQ ID NO: 129841 - DNA, 20 bp, Homo sapiens
  misc_feature 1..20: note = chr8:104235237-104235257
  misc_feature 1..20: note = Hypo
  source 1..20: mol_type = genomic DNA
tttaaaactttttggcgggc

SEQ ID NO: 129842 - DNA, 93 bp, Homo sapiens; identical to SEQ ID NO: 98369
  misc_feature 1..93: note = chr8:104310870-104310963
  misc_feature 1..93: note = Hyper
  source 1..93: mol_type = genomic DNA

SEQ ID NO: 129843 - DNA, 72 bp, Homo sapiens; identical to SEQ ID NO: 98370
  misc_feature 1..72: note = chr8:104311349-104311421
  misc_feature 1..72: note = Hyper
  source 1..72: mol_type = genomic DNA

SEQ ID NO: 129844 - DNA, 165 bp, Homo sapiens; identical to SEQ ID NO: 41884
  misc_feature 1..165: note = chr8:104382635-104382800
  misc_feature 1..165: note = Hypo
  source 1..165: mol_type = genomic DNA

SEQ ID NO: 129845 - DNA, 23 bp, Homo sapiens
  misc_feature 1..23: note = chr8:104488605-104488628
  misc_feature 1..23: note = Hypo
  source 1..23: mol_type = genomic DNA
actgcgcccggcccataatatat

SEQ ID NO: 129846 - DNA, 574 bp, Homo sapiens; identical to SEQ ID NO: 98374
  misc_feature 1..574: note = chr8:104510980-104511554
  misc_feature 1..574: note = Hyper
  source 1..574: mol_type = genomic DNA

SEQ ID NO: 129847 - DNA, 1943 bp, Homo sapiens
  misc_feature 1..1943: note = chr8:104511983-104513926
  misc_feature 1..1943: note = Hyper
  source 1..1943: mol_type = genomic DNA
ctccccgcccggccccggacccagcctggagatcgcgctcgggaggggcggctgccgcccgcggggcgcccgcggtgcccgggcctgggcagcgaggaggtgacgccgcccccgcgggatgagcccgggaggcggaggggcggaggaggtgctggcggcggcactgagcggcggcggcgcagggcgcgcgggccttccgcgccgactccatcgacccaaggggcggcggcggtggcggcggctgagcgaccctgggccgggcgcgtgatgaggaggggccggcgccagaccccgctgcacgtcggagctcgcctggatccgggcgttggcagccgaagggccctggccccgggactctccgccgctagcccccgtcatatcttctccgctttcgcttctccactctagccgggggtggggtgggtggggttggggtctccgcgggggtttccggccccgcggcccgctcccgggtgtgcctggaggagttctccctctgtggcgcgcgggagccctgtgatgcgtcagccggcgggacggatgagttgcttctccgggaaaccgtcctcgcttcctcacgaccctctcggctcccgcctgggtgcccctcgggccggcagtactccgcctccgggcgctcgaagcgagttccccgggggcttgttcgcaggcaccccttcccctccgaggcggcgcgcgcgctcccggccctgaccgcggccggacacactcgcgccccggtccgcctgtcgccctcccgcctgctccctccagtcaccccacccttagctgtccccgccaccttactccaccaccctcccccgcctctccgcgcactccgcgtcccggcctccagttcccctttcccttgaaccgctcacttcacagcccttcgcccccgggaagaagaaacatttcccgaagcgcactcctcagccctccttccccacgcgctcgccctcccctccccctgcttttcttgggggaggggggctgtcgccttggattgaaggccattgatttgtatgtatttgtcccagcgctggaggctgccccagccgccgcgccggtgccgccgctgccagtggagttgcctccccgcttccctagggtggttcggctccaccaaacatgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaagaggagaaggagcagtccgtgctcaagtaaggacctggctccatattcccgcctctctccctgccctccgccccctcgcccactgccctgcggccgcctgcgcgccccagttcgccgccctccctcccgctggcggcgcccaggccacgagggctgcggccagcgccggccgcccgggctgttttaggggtgtctgagagcaggggtgtgtgtcggggagggagggcgccaaggccggctgaggtgagggtggcgagccttaggcggtgtgattttccttggcgcctttccggatttcctcgctggtcatcttggctccggggccccagcgggactggggctgaacccaggctctgtgcgtaccctctcctttcccgccgcgctgaggcagtgactggggcacagaatccaatatggccgtgcacaggtgctccctggacggacccgggcgaaggcgcgctggcaggggatgcggacgccaccctggtcccacgcctccgcggggcggctctaccagcaacgcgggacagagcagggctgcccacagtggctgcgagcagcgggcggcggcgcgggctaggggcctaagctctgtcgcggtcgggtgggtgtgcgtccgccgccatcttccagcccctccccctcggcgagtgctaacaccc

SEQ ID NO: 129848 - DNA, 874 bp, Homo sapiens
  misc_feature 1..874: note = chr8:105235249-105236123
  misc_feature 1..874: note = Hyper
  source 1..874: mol_type = genomic DNA
cctgtgtttgaggagcgttaaaaaaaactgtgaacctgaggaaagggaaagtgactaccagaaatttaccggtttacttatctgagatgcctaactcactgcatctaattagtcaccactccctggccttaaccacgcggagggaagaggaaacagcaggagctactcggagcagctgcccgggacctgaggcgcgcgccccggagccaccagcccaccgaggtgcagccgcgccgccacctccccctccggccgctgattggcggggaccgcagcatcagcggcatctccctgcgcggggagggcagcgagactccagcagctccagcctccaggattctcagctccctcccgggcgagacctcggacgttcactgcgagcagccgctccgcccgccaccgcctccatctcctcctctggacccctctccaataaattggaggtcccggcggccaggaaagccacgtctcctccgggctgggtcagggaggcaggggccagagcctcagggtcccgtggcaccaacctggcttctggcccactggtcccggaaccgctgcggacgctgcgccccagccgccaagacgccgcgtatcttgtaccgcgggaaaagcgggtcctcgtccaagatgggccggcagggcttggggggtgccagcgctgcggggcgctccatgcagcgctcccagagccggagtagcctgtctgcctccttcgaggcactggccggctactttccctgcatgaactccctggaggaggaagaaggaggtgagacaccccttcccccgtagttggtgtctctatctgtttagaaagtcggtggctggagggttggccggggcagagagaactccacgtagcagtgtccca

SEQ ID NO: 129849 - DNA, 227 bp, Homo sapiens; identical to SEQ ID NO: 98385
  misc_feature 1..227: note = chr8:105385866-105386093
  misc_feature 1..227: note = Hypo
  source 1..227: mol_type = genomic DNA

SEQ ID NO: 129850 - DNA, 40 bp, Homo sapiens; identical to SEQ ID NO: 98386
  misc_feature 1..40: note = chr8:105456591-105456631
  misc_feature 1..40: note = Hypo
  source 1..40: mol_type = genomic DNA

SEQ ID NO: 129851 - DNA, 184 bp, Homo sapiens; identical to SEQ ID NO: 98387
  misc_feature 1..184: note = chr8:105459406-105459590
  misc_feature 1..184: note = Hypo
  source 1..184: mol_type = genomic DNA

SEQ ID NO: 129852 - DNA, 706 bp, Homo sapiens
  misc_feature 1..706: note = chr8:105478728-105479434
  misc_feature 1..706: note = Hyper
  source 1..706: mol_type = genomic DNA
ccctctgacacccgccggggctgcgctccttcccgcccacccagctcctcggcgccgcgccgcgcgaggcggccctgctgaggaccccgggacgactggggaggctgcccgagcctccgtgggtaccgcggggcgggggcgcggcggggcgggtaccttggtgccctggtggaagtcgtcgatggaccgcgagcccatgaaggggaactgcatgtgcgtgtgtgtgtcgatgcctccgggcaggacgagcttgccggcggcgtcgaggacccgcagccccgcaggagcgcccccgggaggcagcaggtcgtgcccgagtgcccgcaccacgccgtcctccaccagcacgtcggccacctccgagaagtcatcgttgaccacgcgacccccgcggatcaggagccgcgagggcgccgccatagcgaggggcgcgcggggtcctactcggcccgggctgcgcgcaggggctgggttgggcgggccgggcgggcttggggtgccctcctgcaaggtccccaccgacagcccccgagctctgcctcaggctgcaaatccggagcccggcggcctgacgggtttatgacctggccgcatatgcggctcctccccccgggaaggctgggctggagcccaaaggccgggattgaacaggtccgcatggtccttgcacactcagaccccaagtgttctgcgccctgagttgagg

SEQ ID NO: 129853 - DNA, 120 bp, Homo sapiens; identical to SEQ ID NO: 98391
  misc_feature 1..120: note = chr8:105565464-105565584
  misc_feature 1..120: note = Hypo
  source 1..120: mol_type = genomic DNA

SEQ ID NO: 129854 - DNA, 155 bp, Homo sapiens; identical to SEQ ID NO: 9720
  misc_feature 1..155: note = chr8:105600526-105600681
  misc_feature 1..155: note = Hyper
  source 1..155: mol_type = genomic DNA

SEQ ID NO: 129855 - DNA, 677 bp, Homo sapiens; identical to SEQ ID NO: 98393
  misc_feature 1..677: note = chr8:105601010-105601687
  misc_feature 1..677: note = Hyper
  source 1..677: mol_type = genomic DNA

SEQ ID NO: 129856 - DNA, 152 bp, Homo sapiens; identical to SEQ ID NO: 98394
  misc_feature 1..152: note = chr8:105601931-105602083
  misc_feature 1..152: note = Hyper
  source 1..152: mol_type = genomic DNA

SEQ ID NO: 129857 - DNA, 120 bp, Homo sapiens; identical to SEQ ID NO: 98396
  misc_feature 1..120: note = chr8:105645375-105645495
  misc_feature 1..120: note = Hypo
  source 1..120: mol_type = genomic DNA

SEQ ID NO: 129858 - DNA, 30 bp, Homo sapiens; identical to SEQ ID NO: 98397
  misc_feature 1..30: note = chr8:105692986-105693016
  misc_feature 1..30: note = Hypo
  source 1..30: mol_type = genomic DNA

SEQ ID NO: 129859 - DNA, 28 bp, Homo sapiens
  misc_feature 1..28: note = chr8:105977049-105977077
  misc_feature 1..28: note = Hypo
  source 1..28: mol_type = genomic DNA
gccatcttgtaaccgcccattttattag

SEQ ID NO: 129860 - DNA, 185 bp, Homo sapiens; identical to SEQ ID NO: 98405
  misc_feature 1..185: note = chr8:106155895-106156080
  misc_feature 1..185: note = Hypo
  source 1..185: mol_type = genomic DNA

SEQ ID NO: 129861 - DNA, 896 bp, Homo sapiens
  misc_feature 1..896: note = chr8:106330435-106331331
  misc_feature 1..896: note = Hyper
  source 1..896: mol_type = genomic DNA
ggccctcctccaagccgtccccacgcctcccctccaactcccacccacccctgcccccatcccccaccaccgcctggatcccccgcacttcgcccgaccaaggccggggccgtagtttgcatccggactggatttggatgcagccaatcctcctttggctgatggaatagtctcccctccccacagccccggcgcgcccctccctcgcgcgcctcgccgcctcccgccgcagaacaggagctgcgcggcccggagcggcggcggcggcgccggagtatccgtcccgcacgccggggcgaggggcgagcgagcgcgctcctcctcccgcgccctgcgcccccgcgctccccctctcctcgctgctcgctctcccgtccctccctccttctcttccttctttccgtgttatttttctcttctctttccccttttctctctccctgaccgttcgcttgtacattcccattctccccccgtcgctctcctctccccctcccctcctcactgtcacactctctgtgcccccgtctctcttctctcatttgcttgctcatctccgaacgtgaatccgcggctcccggaggagcccagcgcccggagcacctggagtccggccggcggcgggccgagcctggccagcggcggcggcggcggcggcggcggcgggagccgagggagcggcagccgcgaccgcgggcaccgcgggagccccagcggcagcagccgccgccgagatgtcccggcgaaagcaaagcaaaccccggcagatcaaacgtaagtttgcgcgcggggccgggagttggtgggattattgcccaggagcggggtgcgcgggacgggaaagcggtgggtgggtggcggggctaggggagatccgctcccggtcccctagatgt

SEQ ID NO: 129862 - DNA, 345 bp, Homo sapiens
  misc_feature 1..345: note = chr8:106331843-106332188
  misc_feature 1..345: note = Hyper
  source 1..345: mol_type = genomic DNA
cgtgtcctgggacttcgggcgggtccggctcacgccgccaggacgctcagccgagcggggattcgggtggtgtctggccctggtggcgcgcggagtcctccctgggaggggccgccagtcacttcccagcgcggaagctgtgagttcaaggcggtgggcgcgcaggggagtgcatggccctgagcccccgggtgcccgggggtcccgatggtgcttagaggacacggcgggtcaagagacaccttccgaaacaggcacgctcgcagagatcaagtcggtcaacttttcttggcttggggagaattcctccaatagcgttttataggcctgcgacatatcttcaac

SEQ ID NO: 129863 - DNA, 84 bp, Homo sapiens; identical to SEQ ID NO: 98410
  misc_feature 1..84: note = chr8:106433918-106434002
  misc_feature 1..84: note = Hypo
  source 1..84: mol_type = genomic DNA

SEQ ID NO: 129864 - DNA, 27 bp, Homo sapiens
  misc_feature 1..27: note = chr8:106466086-106466113
  misc_feature 1..27: note = Hypo
  source 1..27: mol_type = genomic DNA
aagtgatccacccgcctcagcctccca

SEQ ID NO: 129865 - DNA, 77 bp, Homo sapiens; identical to SEQ ID NO: 98412
  misc_feature 1..77: note = chr8:106475039-106475116
  misc_feature 1..77: note = Hypo
  source 1..77: mol_type = genomic DNA

SEQ ID NO: 129866 - DNA, 30 bp, Homo sapiens; identical to SEQ ID NO: 15145
  misc_feature 1..30: note = chr8:106500552-106500582
  misc_feature 1..30: note = Hypo
  source 1..30: mol_type = genomic DNA

SEQ ID NO: 129867 - DNA, 38 bp, Homo sapiens; identical to SEQ ID NO: 98415
  misc_feature 1..38: note = chr8:106706481-106706519
  misc_feature 1..38: note = Hypo
  source 1..38: mol_type = genomic DNA

SEQ ID NO: 129868 - DNA, 28 bp, Homo sapiens
  misc_feature 1..28: note = chr8:106713096-106713124
  misc_feature 1..28: note = Hypo
  source 1..28: mol_type = genomic DNA
gcgtgagccactgcgcccagccatccct

SEQ ID NO: 129869 - DNA, 986 bp, Homo sapiens; identical to SEQ ID NO: 98420
  misc_feature 1..986: note = chr8:107281909-107282895
  misc_feature 1..986: note = Hyper
  source 1..986: mol_type = genomic DNA

SEQ ID NO: 129870 - DNA, 1124 bp, Homo sapiens
  misc_feature 1..1124: note = chr8:107283112-107284236
  misc_feature 1..1124: note = Hyper
  source 1..1124: mol_type = genomic DNA
agggacagtgggctccggaggggcgagtggattcggataatttggggaatcagtaaaaggctagggggcacatcatgatggagtcagcctggaatctgtctcccgctagagtacccgaggccacatgttgggaactggctggggaaaggatggatgtagaaagtggcctggagggccgactggaaaatcgctgagggatttgggtgaagagggggggagctgtgcagtatcgggcggaggaactgggctgctggtagggcctgaaaggttcaggagagggttggaggcttccccgtgccgccccttgaatagtgatttagtactgttatctgaggttcactttcacccctggctcctcctccgtctactacccggcttggacgcacctcggctcgctgtaggcgagctttaggagatttaaatagacattaggcagtggggaaggtagtcgtttacggggggagctgctcgggcttccgttcagtggttcccggcacgctcagggtgcagtgtagggtctgaatgtgtgtattgcgggggtagggggagtggtgtcagttctaggccacaggaattcgtggtctggccccagaggtgcggtgtttttggccgggaagtcaggcagaagtctgcagcgtgcaactcgcagcggggcgtgtgtgtgcgtgtgtgcgcgcgcgtgtgcatgtttccggcccggggtcgcgtgtgtggctgcagcctgtctccgtgacaagaagatccagggatctacgggcggcacggggaagggattaaggggaacatacttccctacgtcttttctgcctccttttcccagggtagcattctttgcttatccaatgatgcctctttctaacctctccctctccacttacatcccaaacctgatgcgggtcttctctgattcggcactctaaggaggactcagccgccggctgcgaccaccgtggactccctctatggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcacgatggctccaaaag

SEQ ID NO: 129871 - DNA, 30 bp, Homo sapiens; identical to SEQ ID NO: 41892
  misc_feature 1..30: note = chr8:107359293-107359323
  misc_feature 1..30: note = Hypo
  source 1..30: mol_type = genomic DNA

SEQ ID NO: 129872 - DNA, 185 bp, Homo sapiens; identical to SEQ ID NO: 41893
  misc_feature 1..185: note = chr8:107531614-107531799
  misc_feature 1..185: note = Hypo
  source 1..185: mol_type = genomic DNA

SEQ ID NO: 129873 - DNA, 286 bp, Homo sapiens; identical to SEQ ID NO: 98425
  misc_feature 1..286: note = chr8:107670003-107670289
  misc_feature 1..286: note = Hyper
  source 1..286: mol_type = genomic DNA

SEQ ID NO: 129874 - DNA, 56 bp, Homo sapiens; identical to SEQ ID NO: 98426
  misc_feature 1..56: note = chr8:107670922-107670978
  misc_feature 1..56: note = Hyper
  source 1..56: mol_type = genomic DNA

SEQ ID NO: 129875 - DNA, 18 bp, Homo sapiens
  misc_feature 1..18: note = chr8:107789174-107789192
  misc_feature 1..18: note = Hypo
  source 1..18: mol_type = genomic DNA
gcccggccagctgtggat

SEQ ID NO: 129876 - DNA, 164 bp, Homo sapiens; identical to SEQ ID NO: 98428
  misc_feature 1..164: note = chr8:108134662-108134826
  misc_feature 1..164: note = Hypo
  source 1..164: mol_type = genomic DNA

SEQ ID NO: 129877 - DNA, 312 bp, Homo sapiens; identical to SEQ ID NO: 98429
  misc_feature 1..312: note = chr8:108509338-108509650
  misc_feature 1..312: note = Hyper
  source 1..312: mol_type = genomic DNA

SEQ ID NO: 129878 - DNA, 30 bp, Homo sapiens; identical to SEQ ID NO: 98431
  misc_feature 1..30: note = chr8:108581145-108581175
  misc_feature 1..30: note = Hypo
  source 1..30: mol_type = genomic DNA

SEQ ID NO: 129879 - DNA, 77 bp, Homo sapiens; identical to SEQ ID NO: 41895
  misc_feature 1..77: note = chr8:108582504-108582581
  misc_feature 1..77: note = Hypo
  source 1..77: mol_type = genomic DNA

SEQ ID NO: 129880 - DNA, 17 bp, Homo sapiens
  misc_feature 1..17: note = chr8:108582641-108582658
  misc_feature 1..17: note = Hypo
  source 1..17: mol_type = genomic DNA
ggcggagaaaatattac

SEQ ID NO: 129881 - DNA, 30 bp, Homo sapiens; identical to SEQ ID NO: 41897
  misc_feature 1..30: note = chr8:108588091-108588121
  misc_feature 1..30: note = Hypo
  source 1..30: mol_type = genomic DNA

SEQ ID NO: 129882 - DNA, 30 bp, Homo sapiens; identical to SEQ ID NO: 98435
  misc_feature 1..30: note = chr8:108592924-108592954
  misc_feature 1..30: note = Hypo
  source 1..30: mol_type = genomic DNA

SEQ ID NO: 129883 - DNA, 41 bp, Homo sapiens; identical to SEQ ID NO: 41898
  misc_feature 1..41: note = chr8:108593714-108593755
  misc_feature 1..41: note = Hypo
  source 1..41: mol_type = genomic DNA

SEQ ID NO: 129884 - DNA, 30 bp, Homo sapiens; identical to SEQ ID NO: 98437
  misc_feature 1..30: note = chr8:108594004-108594034
  misc_feature 1..30: note = Hypo
  source 1..30: mol_type = genomic DNA

SEQ ID NO: 129885 - DNA, 393 bp, Homo sapiens; identical to SEQ ID NO: 98438
  misc_feature 1..393: note = chr8:108601650-108602043
  misc_feature 1..393: note = Hypo
  source 1..393: mol_type = genomic DNA

SEQ ID NO: 129886 - DNA, 96 bp, Homo sapiens; identical to SEQ ID NO: 98442
  misc_feature 1..96: note = chr8:108767551-108767647
  misc_feature 1..96: note = Hypo
  source 1..96: mol_type = genomic DNA

SEQ ID NO: 129887 - DNA, 30 bp, Homo sapiens; identical to SEQ ID NO: 41900
  misc_feature 1..30: note = chr8:108957755-108957785
  misc_feature 1..30: note = Hypo
  source 1..30: mol_type = genomic DNA

SEQ ID NO: 129888 - DNA, 2328 bp, Homo sapiens
  misc_feature 1..2328: note = chr8:109093679-109096007
  misc_feature 1..2328: note = Hyper
  source 1..2328: mol_type = genomic DNA
aaaagtccaaagtgccgaatgaaatagacagctctcaccaggtccctgggaaggggctgctgcgcgcccttcctgcgcgggtaattcgatgtgcgtgtggtgagtggtttatgtttaaatccacccagaaaattgaatcgtgtctagccgcccttcttctaaaatgcagttggattagttgcatctccagcggactccgagacagaaatacgcactaaatctgcaggaaagcgagttccccgaaacctttctggaggcttccacccgccttctccgctacgcacaagtgatggagagggagggagcagttaaaaagccgcaagtgaatttcattgagaacagaagcctccaccggtgtggctgcttttgcaaagcaaatggagagagcgaagtggggcctgttttaaaaacaaacctctggaggcgaggactccccagaaaaccagcgcgggaattgctgcttaattcagaaagttcccatctcgtcgcagtttccagaaaaaagagatctatgttggcctttttctggaaagggaggtcctccccctcgacttggtacccctcccaagctccggaatacagacacacgcttgggtacacccacacaccacacacacactatgctaggtcaagtccgaagagatctgaggccgggtttggggcgcacgtggatggggaagataaaacaaatgagctacagggaagatggttaggaggacagagagaagaacaacgacgacaaaaaaaaaatgcatgtcagataagaaatacgtcctaaagagacaagtttagatgaggaggtggggcggcgaacatgagtgcggaccgcacgacttagccctgagcgcccgattggcgcccggctcgccgagctcccagcgcgtctcgctccggctccccgcgcctccagggtacagaaaacagagtgttttgtagagctccagggtcctaaaggtggggactggggacccgcaaaagctggggtggagagcacagccctgaccatctgagcccccggagccagggcgtgagtgagcgcctccacacgccacccctgaagcccaccacgcacctttggcagagagggacccacctcgcttactgcgtctccatcggttgccttggcagtggctgtaatccatgcagttcagaatgatgagggcaaaggagaaaaggcgaaactgcatctgggcggtcgggcgggggagagacgcctctcaaagtctaggaactggagggttcgcccaaagagccggcgccggccgcgctgctggggaggactcagagggagactcgccactcacccccgggccgcaccggtcagttcagcgcgatcagcatctctccgccacgaacctgagagacaagaagcgaaaacagggtgtgtgggggatggagagagccccggggaggcagctgcgccttcgcacgtcccaatttaaagaagagagggaaggaggaagcgaacccactgcctagcacgagccgcggagcggcttaatccagagcgggcagctgcggacgagttggagaggaaggtgattataatcagtgaattagcaacctctgccgagccctaagctccgacccagcggcataatgcgttgtgccggcgctccggggaaaggaaagaactctaaaggcactgagagcgcagggctaaaagaacgctcttaggccatttggagtccacggcggtgtacccaagcgccgcagctgcggctgccttggtgtgggttgcctaccgtgcgcacgtctcgggcggcgcggcctccctaggcgcggtgctccatcccgggctcgggaagcgagccgcttggttagcacgtgggctggggaaaagtttgccgagaccggctgggagcgcctggcagctctggaattccagcggccgccgcggggttggcgacgccaggcaggagcgcggagcggcgggtgcagccactgggatgctccgtccccgcccgcgagcgcggtccccaggcaaggggtgcgcccgctcacactctctgcctccctaaccaattgtgtcgcttcctgcgctttctccacggtcacttcacagctaagatttctttctttccgagctgtagaaggcagaacgctctcgggaggacgaagtgatccgaagggatgtggcaagcgcactttccgatggagatgcagaccggctgaggcttgggatgcttctataagtaggtggtgctgtggtccaaggcatctaagtctaggctgcctcggagttcctgggtcctaaagccagaaacgtcccggtttccctgaggtcctaaagaacgttgacagccaacagcgcgcctaacttggagc

SEQ ID NO: 129889 - DNA, 148 bp, Homo sapiens; identical to SEQ ID NO: 98449
  misc_feature 1..148: note = chr8:109104980-109105128
  misc_feature 1..148: note = Hypo
  source 1..148: mol_type = genomic DNA

SEQ ID NO: 129890 - DNA, 43 bp, Homo sapiens; identical to SEQ ID NO: 98450
  misc_feature 1..43: note = chr8:109144123-109144166
  misc_feature 1..43: note = Hypo
  source 1..43: mol_type = genomic DNA

SEQ ID NO: 129891 - DNA, 56 bp, Homo sapiens; identical to SEQ ID NO: 98452
  misc_feature 1..56: note = chr8:109273857-109273913
  misc_feature 1..56: note = Hypo
  source 1..56: mol_type = genomic DNA

SEQ ID NO: 129892 - DNA, 30 bp, Homo sapiens; identical to SEQ ID NO: 98454
  misc_feature 1..30: note = chr8:109311321-109311351
  misc_feature 1..30: note = Hypo
  source 1..30: mol_type = genomic DNA

SEQ ID NO: 129893 - DNA, 489 bp, Homo sapiens
  misc_feature 1..489: note = chr8:109799414-109799903
  misc_feature 1..489: note = Hyper
  source 1..489: mol_type = genomic DNA
aggcaaggctgatctcggggaggcgacctctggatgcgccctgtgcgagcaaagccgggagagcgagccccaagcacctggcagcggtgcccccagcaggcgccgaggaatccggctatccatttctggtgaactctgcgcccactgaggcattcgaggtacggatgtgtccgcctagtactcggagacgaaggagagagagcggggatatgcgctccagctctgctaggctccagggctctcacccttgcattcaaagcctccaccccatcccactccccgccactcaccttctgcttcggccacccggtgcggctccagcaccgcgcgctctcccggcacggttcccggagaaagtcccccaatcaccagctacggcacttgtagcctctgcacgccgctcggctccgccgggtgggcagcgcccgccacggcgggcggggtggggcggggcggggcgctcccggagcatcccgggagttgtaggcc

SEQ ID NO: 129894 - DNA, 28 bp, Homo sapiens
  misc_feature 1..28: note = chr8:110086844-110086872
  misc_feature 1..28: note = Hypo
  source 1..28: mol_type = genomic DNA
caacaaaagaatacgcaggtgcacagta

SEQ ID NO: 129895 - DNA, 31 bp, Homo sapiens; identical to SEQ ID NO: 41901
  misc_feature 1..31: note = chr8:110274990-110275021
  misc_feature 1..31: note = Hypo
  source 1..31: mol_type = genomic DNA

SEQ ID NO: 129896 - DNA, 104 bp, Homo sapiens; identical to SEQ ID NO: 98461
  misc_feature 1..104: note = chr8:110406021-110406125
  misc_feature 1..104: note = Hypo
  source 1..104: mol_type = genomic DNA

SEQ ID NO: 129897 - DNA, 224 bp, Homo sapiens; identical to SEQ ID NO: 98462
  misc_feature 1..224: note = chr8:110479232-110479456
  misc_feature 1..224: note = Hypo
  source 1..224: mol_type = genomic DNA

SEQ ID NO: 129898 - DNA, 171 bp, Homo sapiens; identical to SEQ ID NO: 15148
  misc_feature 1..171: note = chr8:110548417-110548588
  misc_feature 1..171: note = Hypo
  source 1..171: mol_type = genomic DNA

SEQ ID NO: 129899 - DNA, 51 bp, Homo sapiens; identical to SEQ ID NO: 98468
  misc_feature 1..51: note = chr8:110592338-110592389
  misc_feature 1..51: note = Hypo
  source 1..51: mol_type = genomic DNA

SEQ ID NO: 129900 - DNA, 409 bp, Homo sapiens; identical to SEQ ID NO: 98469
  misc_feature 1..409: note = chr8:110703524-110703933
  misc_feature 1..409: note = Hyper
  source 1..409: mol_type = genomic DNA

SEQ ID NO: 129901 - DNA, 116 bp, Homo sapiens; identical to SEQ ID NO: 98470
  misc_feature 1..116: note = chr8:110704189-110704305
  misc_feature 1..116: note = Hyper
  source 1..116: mol_type = genomic DNA

SEQ ID NO: 129902 - DNA, 30 bp, Homo sapiens; identical to SEQ ID NO: 15149
  misc_feature 1..30: note = chr8:110961977-110962007
  misc_feature 1..30: note = Hypo
  source 1..30: mol_type = genomic DNA

SEQ ID NO: 129903 - DNA, 1010 bp, Homo sapiens
  misc_feature 1..1010: note = chr8:110986212-110987222
  misc_feature 1..1010: note = Hyper
  source 1..1010: mol_type = genomic DNA
ctgcaggaaggagagcgcgcacagctgctccatgacatgcaggcggccggtgcggtagtagtgcaggacatatcggaacgcctgcgagctgcggtcgaagaagtactcgttgtccacggggttggcatcgtcgcaaagctccagagggctgggcacggcggccagggccccggggcggcggtaggaagccaccaccacggccagcttgccaaggcgcgtgtgcgggaagcaggacagcgcctgctgcgagagcacgaagcggctgccgcccacgttgaccgtgaagcagtccccgagcgccaagggctccccttcaccctcgctgcagaagacactagagtccagggaggtcagggagccgctgtccagcggcgagtccagcagcgctctgccgctggaaggcatctctaacccagtcgccgcggcctgagggcgccacaaagttggggacacgccggaagctttggtcccgcgagggcggtggcacggcccctggtggcggccgggattccccgggctcccgaaggggttacctctccttggcgcaccctctccacccgctgtgcgccttcctcctcctgccgctagggagccgggagtgcgcggaagcagcgcacaagtggcagaaagaggagacagggagcagaggaagggtcgcgctaagagagaggatcaggtgaggtccaagcccgacacagtccctgtgcacactgccggtcgccctggcccttcccaaacgttgtcaccccgcctcccaacttcgcaattgcgattcccagcccaggaggtgtacagattgaatgactcgctacttggtgggtggaggggttggggaagggaggaaggagggagatgtggggcggaggaggaggaagaggagagaagatgactcttagctgaacgcaagcaagcaagcaagcaagggggatggcgagactcactcctgcccgcaggagaccaaaacaaaaagttcagaaagcaaaggaagtggtaaccgggtcccttccaac

SEQ ID NO: 129904 - DNA, 275 bp, Homo sapiens; identical to SEQ ID NO: 98476
  misc_feature 1..275: note = chr8:110987681-110987956
  misc_feature 1..275: note = Hyper
  source 1..275: mol_type = genomic DNA

SEQ ID NO: 129905 - DNA, 29 bp, Homo sapiens
  misc_feature 1..29: note = chr8:111003707-111003736
  misc_feature 1..29: note = Hypo
  source 1..29: mol_type = genomic DNA
gagtgcagtggctcacgcctctaatccca

SEQ ID NO: 129906 - DNA, 18 bp, Homo sapiens
  misc_feature 1..18: note = chr8:111194106-111194124
  misc_feature 1..18: note = Hypo
  source 1..18: mol_type = genomic DNA
gcccggccagggtttttt

SEQ ID NO: 129907 - DNA, 30 bp, Homo sapiens; identical to SEQ ID NO: 41905
  misc_feature 1..30: note = chr8:111586661-111586691
  misc_feature 1..30: note = Hypo
  source 1..30: mol_type = genomic DNA

SEQ ID NO: 129908 - DNA, 244 bp, Homo sapiens; identical to SEQ ID NO: 98480
  misc_feature 1..244: note = chr8:111747443-111747687
  misc_feature 1..244: note = Hypo
  source 1..244: mol_type = genomic DNA

SEQ ID NO: 129909 - DNA, 28 bp, Homo sapiens
  misc_feature 1..28: note = chr8:112347537-112347565
  misc_feature 1..28: note = Hypo
  source 1..28: mol_type = genomic DNA
ctgatgtgttcctcacgacgtccagctg

SEQ ID NO: 129910 - DNA, 67 bp, Homo sapiens; identical to SEQ ID NO: 98486
  misc_feature 1..67: note = chr8:112636560-112636627
  misc_feature 1..67: note = Hypo
  source 1..67: mol_type = genomic DNA

SEQ ID NO: 129911 - DNA, 16 bp, Homo sapiens
  misc_feature 1..16: note = chr8:113095708-113095724
  misc_feature 1..16: note = Hypo
  source 1..16: mol_type = genomic DNA
acgctgtcacctctca

SEQ ID NO: 129912 - DNA, 150 bp, Homo sapiens; identical to SEQ ID NO: 98489
  misc_feature 1..150: note = chr8:113146123-113146273
  misc_feature 1..150: note = Hypo
  source 1..150: mol_type = genomic DNA

SEQ ID NO: 129913 - DNA, 203 bp, Homo sapiens; identical to SEQ ID NO: 98490
  misc_feature 1..203: note = chr8:113175066-113175269
  misc_feature 1..203: note = Hypo
  source 1..203: mol_type = genomic DNA

SEQ ID NO: 129914 - DNA, 30 bp, Homo sapiens; identical to SEQ ID NO: 98491
  misc_feature 1..30: note = chr8:113221643-113221673
  misc_feature 1..30: note = Hypo
  source 1..30: mol_type = genomic DNA

SEQ ID NO: 129915 - DNA, 162 bp, Homo sapiens
  misc_feature 1..162: note = chr8:114444379-114444541
  misc_feature 1..162: note = Hyper
  source 1..162: mol_type = genomic DNA
ccaaccagatgattccggaaagtacggtgctgcaaaaggacatttcagagcgctttcaacaagctaactgtccagtgaagttcagctccgaattctggtaaccgttcaagccctgtcagtccggtaaattgggttaacttagcaactcggtggtgcaaagcc

SEQ ID NO: 129916 - DNA, 447 bp, Homo sapiens; identical to SEQ ID NO: 98501
  misc_feature 1..447: note = chr8:114444784-114445231
  misc_feature 1..447: note = Hyper
  source 1..447: mol_type = genomic DNA

SEQ ID NO: 129917 - DNA, 500 bp, Homo sapiens; identical to SEQ ID NO: 32247
  misc_feature 1..500: note = chr8:114445521-114446021
  misc_feature 1..500: note = Hyper
  source 1..500: mol_type = genomic DNA

SEQ ID NO: 129918 - DNA, 517 bp, Homo sapiens
  misc_feature 1..517: note = chr8:114446931-114447448
  misc_feature 1..517: note = Hyper
  source 1..517: mol_type = genomic DNA
tctccaaagctaaaccgattatatcagtccaaagtaaattaacgcgcctttcctttctatcggcgcatctcattcggaaaatacggtaggtgcgggcagccggggctctaattgcaggcggcgcggatcagcgttagtcaggctgtaatgctcgccccgcttcggagacttccctccccctcatctgcccccgaatgtgttttggctcaacaggtatcacatgaaaactcgcacttaaaccctggtcatcttctcacaggagccacccttacatttttctgccagggctgctgctggctattcgcgcctcccccacgcgaagcgcgcgtctagcaggcagccccagggccatccattaaccaccaactcccagtggcaggcgaactaagcataaatgtgtggctcctcacccgtcgagccagcgacaaagaaaccttgtaagcaacctgagccgtgctttgtacatttggcagtgtagttgtgccacttaggacaagcttttcggctcagagctgct

SEQ ID NO: 129919 - DNA, 63 bp, Homo sapiens; identical to SEQ ID NO: 98505
  misc_feature 1..63: note = chr8:114447789-114447852
  misc_feature 1..63: note = Hyper
  source 1..63: mol_type = genomic DNA

SEQ ID NO: 129920 - DNA, 849 bp, Homo sapiens; identical to SEQ ID NO: 98506
  misc_feature 1..849: note = chr8:114448753-114449602
  misc_feature 1..849: note = Hyper
  source 1..849: mol_type = genomic DNA

SEQ ID NO: 129921 - DNA, 29 bp, Homo sapiens
  misc_feature 1..29: note = chr8:115020800-115020829
  misc_feature 1..29: note = Hypo
  source 1..29: mol_type = genomic DNA
gcacccggcggggctcggtggctcacgcc

SEQ ID NO: 129922 - DNA, 20 bp, Homo sapiens
  misc_feature 1..20: note = chr8:115089750-115089770
  misc_feature 1..20: note = Hypo
  source 1..20: mol_type = genomic DNA
tgagtgaatgccagccgggt

SEQ ID NO: 129923 - DNA, 37 bp, Homo sapiens; identical to SEQ ID NO: 98528
  misc_feature 1..37: note = chr8:115649501-115649538
  misc_feature 1..37: note = Hypo
  source 1..37: mol_type = genomic DNA

SEQ ID NO: 129924 - DNA, 28 bp, Homo sapiens
  misc_feature 1..28: note = chr8:116354110-116354138
  misc_feature 1..28: note = Hypo
  source 1..28: mol_type = genomic DNA
tttttttttttgagacggagtcttgctc

SEQ ID NO: 129925 - DNA, 528 bp, Homo sapiens
  misc_feature 1..528: note = chr8:116660295-116660823
  misc_feature 1..528: note = Hyper
  source 1..528: mol_type = genomic DNA
aagaggaaatcagagcgtcaaatcaaggaggggtggcagcaaagaggaagcaaaagagaagacaagaggaaagagagtttatggagagaggaagccaatttgggaagtggggagaagggcaggctggccaggggatgcgacgcgacagggcagagggagtgggaagaagcgggcaggaggcggcctccacgcagctggcagggcaggcagcgctggagagggaggaggagagggaggctgcaggcaccgcgcagcagccgaggatgagagaggtaaccggagggaacgggcgcacacaactgcttccgcaggacttcctgcgataacacgcccacagcccgggcgccgagcacgcgtggtggcggccgcaggcccggggctcctgcgagagcgaacgccagcgacacacacgcagctcctgttgtgtcgccgctgccgcctaggcagggccgcagacagcagcctccttcccagactgagccaactcactctcaccgtagctgctccagaatccgtgaaaagaaaatg

SEQ ID NO: 129926 - DNA, 170 bp, Homo sapiens; identical to SEQ ID NO: 41911
  misc_feature 1..170: note = chr8:116710279-116710449
  misc_feature 1..170: note = Hypo
  source 1..170: mol_type = genomic DNA

SEQ ID NO: 129927 - DNA, 30 bp, Homo sapiens; identical to SEQ ID NO: 98535
  misc_feature 1..30: note = chr8:116991751-116991781
  misc_feature 1..30: note = Hypo
  source 1..30: mol_type = genomic DNA

SEQ ID NO: 129928 - DNA, 153 bp, Homo sapiens; identical to SEQ ID NO: 98538
  misc_feature 1..153: note = chr8:117065205-117065358
  misc_feature 1..153: note = Hypo
  source 1..153: mol_type = genomic DNA

SEQ ID NO: 129929 - DNA, 30 bp, Homo sapiens; identical to SEQ ID NO: 98541
  misc_feature 1..30: note = chr8:117572696-117572726
  misc_feature 1..30: note = Hypo
  source 1..30: mol_type = genomic DNA

SEQ ID NO: 129930 - DNA, 18 bp, Homo sapiens
  misc_feature 1..18: note = chr8:117621492-117621510
  misc_feature 1..18: note = Hypo
  source 1..18: mol_type = genomic DNA
gagcgagactccatctca

SEQ ID NO: 129931 - DNA, 147 bp, Homo sapiens; identical to SEQ ID NO: 98544
  misc_feature 1..147: note = chr8:117824014-117824161
  misc_feature 1..147: note = Hypo
  source 1..147: mol_type = genomic DNA

SEQ ID NO: 129932 - DNA, 639 bp, Homo sapiens; identical to SEQ ID NO: 32256
  misc_feature 1..639: note = chr8:117950319-117950958
  misc_feature 1..639: note = Hyper
  source 1..639: mol_type = genomic DNA

SEQ ID NO: 129933 - DNA, 23 bp, Homo sapiens
  misc_feature 1..23: note = chr8:118453896-118453919
  misc_feature 1..23: note = Hypo
  source 1..23: mol_type = genomic DNA
agccaccgcgcctggccacgcaa

SEQ ID NO: 129934 - DNA, 30 bp, Homo sapiens; identical to SEQ ID NO: 98548
  misc_feature 1..30: note = chr8:119057219-119057249
  misc_feature 1..30: note = Hypo
  source 1..30: mol_type = genomic DNA

SEQ ID NO: 129935 - DNA, 37 bp, Homo sapiens; identical to SEQ ID NO: 98549
  misc_feature 1..37: note = chr8:119571068-119571105
  misc_feature 1..37: note = Hypo
  source 1..37: mol_type = genomic DNA

SEQ ID NO: 129936 - DNA, 63 bp, Homo sapiens; identical to SEQ ID NO: 98550
  misc_feature 1..63: note = chr8:119964391-119964454
  misc_feature 1..63: note = Hyper
  source 1..63: mol_type = genomic DNA

SEQ ID NO: 129937 - DNA, 45 bp, Homo sapiens; identical to SEQ ID NO: 98552
  misc_feature 1..45: note = chr8:120220486-120220531
  misc_feature 1..45: note = Hyper
  source 1..45: mol_type = genomic DNA

SEQ ID NO: 129938 - DNA, 45 bp, Homo sapiens; identical to SEQ ID NO: 98554
  misc_feature 1..45: note = chr8:120319364-120319409
  misc_feature 1..45: note = Hypo
  source 1..45: mol_type = genomic DNA

SEQ ID NO: 129939 - DNA, 231 bp, Homo sapiens; identical to SEQ ID NO: 98556
  misc_feature 1..231: note = chr8:120428491-120428722
  misc_feature 1..231: note = Hyper
  source 1..231: mol_type = genomic DNA

SEQ ID NO: 129940 - DNA, 54 bp, Homo sapiens; identical to SEQ ID NO: 98557
  misc_feature 1..54: note = chr8:120429002-120429056
  misc_feature 1..54: note = Hyper
  source 1..54: mol_type = genomic DNA

SEQ ID NO: 129941 - DNA, 30 bp, Homo sapiens; identical to SEQ ID NO: 98558
  misc_feature 1..30: note = chr8:120429286-120429316
  misc_feature 1..30: note = Hyper
  source 1..30: mol_type = genomic DNA

SEQ ID NO: 129942 - DNA, 30 bp, Homo sapiens; identical to SEQ ID NO: 98560
  misc_feature 1..30: note = chr8:120525191-120525221
  misc_feature 1..30: note = Hypo
  source 1..30: mol_type = genomic DNA

SEQ ID NO: 129943 - DNA, 30 bp, Homo sapiens; identical to SEQ ID NO: 98561
  misc_feature 1..30: note = chr8:120591921-120591951
  misc_feature 1..30: note = Hypo
  source 1..30: mol_type = genomic DNA

SEQ ID NO: 129944 - DNA, 16 bp, Homo sapiens
  misc_feature 1..16: note = chr8:120695441-120695457
  misc_feature 1..16: note = Hypo
  source 1..16: mol_type = genomic DNA
gcgcccagcctttata

SEQ ID NO: 129945 - DNA, 31 bp, Homo sapiens; identical to SEQ ID NO: 98563
  misc_feature 1..31: note = chr8:120844095-120844126
  misc_feature 1..31: note = Hypo
  source 1..31: mol_type = genomic DNA

SEQ ID NO: 129946 - DNA, 39 bp, Homo sapiens; identical to SEQ ID NO: 98564
  misc_feature 1..39: note = chr8:120845542-120845581
  misc_feature 1..39: note = Hypo
  source 1..39: mol_type = genomic DNA

SEQ ID NO: 129947 - DNA, 19 bp, Homo sapiens
  misc_feature 1..19: note = chr8:121002670-121002689
  misc_feature 1..19: note = Hypo
  source 1..19: mol_type = genomic DNA
caggcgtgagccaccatgc

SEQ ID NO: 129948 - DNA, 23 bp, Homo sapiens
  misc_feature 1..23: note = chr8:121135619-121135642
  misc_feature 1..23: note = Hypo
  source 1..23: mol_type = genomic DNA
accgcgcccggccaattttctgt

SEQ ID NO: 129949 - DNA, 89 bp, Homo sapiens; identical to SEQ ID NO: 98568
  misc_feature 1..89: note = chr8:121135998-121136087
  misc_feature 1..89: note = Hyper
  source 1..89: mol_type = genomic DNA

SEQ ID NO: 129950 - DNA, 956 bp, Homo sapiens; identical to SEQ ID NO: 98569
  misc_feature 1..956: note = chr8:121136826-121137782
  misc_feature 1..956: note = Hyper
  source 1..956: mol_type = genomic DNA

SEQ ID NO: 129951 - DNA, 28 bp, Homo sapiens
  misc_feature 1..28: note = chr8:121206406-121206434
  misc_feature 1..28: note = Hypo
  source 1..28: mol_type = genomic DNA
agccattcctattcggccatcttggctg

SEQ ID NO: 129952 - DNA, 30 bp, Homo sapiens; identical to SEQ ID NO: 98571
  misc_feature 1..30: note = chr8:121289793-121289823
  misc_feature 1..30: note = Hypo
  source 1..30: mol_type = genomic DNA

SEQ ID NO: 129953 - DNA, 30 bp, Homo sapiens; identical to SEQ ID NO: 41916
  misc_feature 1..30: note = chr8:121354745-121354775
  misc_feature 1..30: note = Hypo
  source 1..30: mol_type = genomic DNA

SEQ ID NO: 129954 - DNA, 32 bp, Homo sapiens; identical to SEQ ID NO: 98573
  misc_feature 1..32: note = chr8:121479576-121479608
  misc_feature 1..32: note = Hypo
  source 1..32: mol_type = genomic DNA

SEQ ID NO: 129955 - DNA, 138 bp, Homo sapiens; identical to SEQ ID NO: 98574
  misc_feature 1..138: note = chr8:121545084-121545222
  misc_feature 1..138: note = Hypo
  source 1..138: mol_type = genomic DNA

SEQ ID NO: 129956 - DNA, 30 bp, Homo sapiens; identical to SEQ ID NO: 41917
  misc_feature 1..30: note = chr8:121566445-121566475
  misc_feature 1..30: note = Hypo
  source 1..30: mol_type = genomic DNA

SEQ ID NO: 129957 - DNA, 30 bp, Homo sapiens; identical to SEQ ID NO: 41918
  misc_feature 1..30: note = chr8:121573169-121573199
  misc_feature 1..30: note = Hypo
  source 1..30: mol_type = genomic DNA

SEQ ID NO: 129958 - DNA, 97 bp, Homo sapiens; identical to SEQ ID NO: 98577
  misc_feature 1..97: note = chr8:121629842-121629939
  misc_feature 1..97: note = Hypo
  source 1..97: mol_type = genomic DNA

SEQ ID NO: 129959 - DNA, 108 bp, Homo sapiens; identical to SEQ ID NO: 98578
  misc_feature 1..108: note = chr8:121643554-121643662
  misc_feature 1..108: note = Hypo
  source 1..108: mol_type = genomic DNA

SEQ ID NO: 129960 - DNA, 54 bp, Homo sapiens; identical to SEQ ID NO: 98579
  misc_feature 1..54: note = chr8:121705929-121705983
  misc_feature 1..54: note = Hypo
  source 1..54: mol_type = genomic DNA

SEQ ID NO: 129961 - DNA, 75 bp, Homo sapiens; identical to SEQ ID NO: 41919
  misc_feature 1..75: note = chr8:121712263-121712338
  misc_feature 1..75: note = Hypo
  source 1..75: mol_type = genomic DNA

SEQ ID NO: 129962 - DNA, 205 bp, Homo sapiens; identical to SEQ ID NO: 98581
  misc_feature 1..205: note = chr8:121717222-121717427
  misc_feature 1..205: note = Hypo
  source 1..205: mol_type = genomic DNA

SEQ ID NO: 129963 - DNA, 183 bp, Homo sapiens; identical to SEQ ID NO: 41920
  misc_feature 1..183: note = chr8:121732132-121732315
  misc_feature 1..183: note = Hypo
  source 1..183: mol_type = genomic DNA

SEQ ID NO: 129964 - DNA, 29 bp, Homo sapiens
  misc_feature 1..29: note = chr8:121823901-121823930
  misc_feature 1..29: note = Hyper
  source 1..29: mol_type = genomic DNA
ccgatgccgttgtacgccgcagcgccctc

SEQ ID NO: 129965 - DNA, 278 bp, Homo sapiens
  misc_feature 1..278: note = chr8:121824203-121824481
  misc_feature 1..278: note = Hyper
  source 1..278: mol_type = genomic DNA
ggcacgcgggactccgctccgggagttcgcagacgcactcggcgggagttggcagctgcactcaggctggttccccctcgcctgatcctgaccggggtggagcaacctaaaagaagaaggagagaccgagacaggggaggggaaaaaagccagcagccagttgcaaaaccccaaagcaaggggagccgcggagcagctcagcgctggagagagtccgtgggaggaggcacgctggcggtgaagggcggggacccacaacccagcggccgctcacctgt

SEQ ID NO: 129966 - DNA, 233 bp, Homo sapiens; identical to SEQ ID NO: 98583
  misc_feature 1..233: note = chr8:121825604-121825837
  misc_feature 1..233: note = Hypo
  source 1..233: mol_type = genomic DNA

SEQ ID NO: 129967 - DNA, 25 bp, Homo sapiens
  misc_feature 1..25: note = chr8:121855050-121855075
  misc_feature 1..25: note = Hypo
  source 1..25: mol_type = genomic DNA
cgcacccggccggaaaacatatttt

SEQ ID NO: 129968 - DNA, 144 bp, Homo sapiens; identical to SEQ ID NO: 41922
  misc_feature 1..144: note = chr8:121982491-121982635
  misc_feature 1..144: note = Hypo
  source 1..144: mol_type = genomic DNA

SEQ ID NO: 129969 - DNA, 30 bp, Homo sapiens; identical to SEQ ID NO: 98587
  misc_feature 1..30: note = chr8:122402000-122402030
  misc_feature 1..30: note = Hypo
  source 1..30: mol_type = genomic DNA

SEQ ID NO: 129970 - DNA, 799 bp, Homo sapiens; identical to SEQ ID NO: 98588
  misc_feature 1..799: note = chr8:122651726-122652525
  misc_feature 1..799: note = Hyper
  source 1..799: mol_type = genomic DNA

SEQ ID NO: 129971 - DNA, 30 bp, Homo sapiens; identical to SEQ ID NO: 98589
  misc_feature 1..30: note = chr8:122653102-122653132
  misc_feature 1..30: note = Hyper
  source 1..30: mol_type = genomic DNA

SEQ ID NO: 129972 - DNA, 106 bp, Homo sapiens; identical to SEQ ID NO: 98590
  misc_feature 1..106: note = chr8:122654322-122654428
  misc_feature 1..106: note = Hyper
  source 1..106: mol_type = genomic DNA

SEQ ID NO: 129973 - DNA, 258 bp, Homo sapiens; identical to SEQ ID NO: 98591
  misc_feature 1..258: note = chr8:123695489-123695747
  misc_feature 1..258: note = Hypo
  source 1..258: mol_type = genomic DNA

SEQ ID NO: 129974 - DNA, 347 bp, Homo sapiens; identical to SEQ ID NO: 41924
  misc_feature 1..347: note = chr8:123966045-123966392
  misc_feature 1..347: note = Hypo
  source 1..347: mol_type = genomic DNA

SEQ ID NO: 129975 - DNA, 26 bp, Homo sapiens
  misc_feature 1..26: note = chr8:124001542-124001568
  misc_feature 1..26: note = Hypo
  source 1..26: mol_type = genomic DNA
ttggataacaagtcccgtggctgggc

SEQ ID NO: 129976 - DNA, 105 bp, Homo sapiens; identical to SEQ ID NO: 41925
  misc_feature 1..105: note = chr8:124055130-124055235
  misc_feature 1..105: note = Hypo
  source 1..105: mol_type = genomic DNA

SEQ ID NO: 129977 - DNA, 45 bp, Homo sapiens; identical to SEQ ID NO: 41926
  misc_feature 1..45: note = chr8:124055535-124055580
  misc_feature 1..45: note = Hypo
  source 1..45: mol_type = genomic DNA

SEQ ID NO: 129978 - DNA, 142 bp, Homo sapiens; identical to SEQ ID NO: 98597
  misc_feature 1..142: note = chr8:124168256-124168398
  misc_feature 1..142: note = Hypo
  source 1..142: mol_type = genomic DNA

SEQ ID NO: 129979 - DNA, 30 bp, Homo sapiens; identical to SEQ ID NO: 98598
  misc_feature 1..30: note = chr8:124169134-124169164
  misc_feature 1..30: note = Hyper
  source 1..30: mol_type = genomic DNA

SEQ ID NO: 129980 - DNA, 656 bp, Homo sapiens; identical to SEQ ID NO: 98599
  misc_feature 1..656: note = chr8:124172796-124173452
  misc_feature 1..656: note = Hyper
  source 1..656: mol_type = genomic DNA

SEQ ID NO: 129981 - DNA, 33 bp, Homo sapiens; identical to SEQ ID NO: 98600
  misc_feature 1..33: note = chr8:124185498-124185531
  misc_feature 1..33: note = Hypo
  source 1..33: mol_type = genomic DNA

SEQ ID NO: 129982 - DNA, 16 bp, Homo sapiens
  misc_feature 1..16: note = chr8:124193486-124193502
  misc_feature 1..16: note = Hypo
  source 1..16: mol_type = genomic DNA
gcgccacactttaaaa

SEQ ID NO: 129983 - DNA, 28 bp, Homo sapiens
  misc_feature 1..28: note = chr8:124248750-124248778
  misc_feature 1..28: note = Hypo
  source 1..28: mol_type = genomic DNA
gggtgcagtggctcacgcctataatccc

SEQ ID NO: 129984 - DNA, 30 bp, Homo sapiens; identical to SEQ ID NO: 98603
  misc_feature 1..30: note = chr8:124255278-124255308
  misc_feature 1..30: note = Hypo
  source 1..30: mol_type = genomic DNA

SEQ ID NO: 129985 - DNA, 17 bp, Homo sapiens
  misc_feature 1..17: note = chr8:124288888-124288905
  misc_feature 1..17: note = Hypo
  source 1..17: mol_type = genomic DNA
gccgatgactaggtttt

SEQ ID NO: 129986 - DNA, 41 bp, Homo sapiens; identical to SEQ ID NO: 98605
  misc_feature 1..41: note = chr8:124374923-124374964
  misc_feature 1..41: note = Hypo
  source 1..41: mol_type = genomic DNA

SEQ ID NO: 129987 - DNA, 20 bp, Homo sapiens
  misc_feature 1..20: note = chr8:124428122-124428142
  misc_feature 1..20: note = Hypo
  source 1..20: mol_type = genomic DNA
gcacccggccctaaacacta

SEQ ID NO: 129988 - DNA, 211 bp, Homo sapiens; identical to SEQ ID NO: 98607
  misc_feature 1..211: note = chr8:124632114-124632325
  misc_feature 1..211: note = Hypo
  source 1..211: mol_type = genomic DNA

SEQ ID NO: 129989 - DNA, 43 bp, Homo sapiens; identical to SEQ ID NO: 98609
  misc_feature 1..43: note = chr8:124934797-124934840
  misc_feature 1..43: note = Hyper
  source 1..43: mol_type = genomic DNA

SEQ ID NO: 129990 - DNA, 209 bp, Homo sapiens; identical to SEQ ID NO: 98612
  misc_feature 1..209: note = chr8:125184265-125184474
  misc_feature 1..209: note = Hypo
  source 1..209: mol_type = genomic DNA

SEQ ID NO: 129991 - DNA, 36 bp, Homo sapiens; identical to SEQ ID NO: 41930
  misc_feature 1..36: note = chr8:125452639-125452675
  misc_feature 1..36: note = Hypo
  source 1..36: mol_type = genomic DNA

SEQ ID NO: 129992 - DNA, 97 bp, Homo sapiens; identical to SEQ ID NO: 41929
  misc_feature 1..97: note = chr8:125452302-125452399
  misc_feature 1..97: note = Hypo
  source 1..97: mol_type = genomic DNA

SEQ ID NO: 129993 - DNA, 30 bp, Homo sapiens; identical to SEQ ID NO: 41931
  misc_feature 1..30: note = chr8:125568984-125569014
  misc_feature 1..30: note = Hypo
  source 1..30: mol_type = genomic DNA

SEQ ID NO: 129994 - DNA, 30 bp, Homo sapiens; identical to SEQ ID NO: 98616
  misc_feature 1..30: note = chr8:125574006-125574036
  misc_feature 1..30: note = Hypo
  source 1..30: mol_type = genomic DNA

SEQ ID NO: 129995 - DNA, 30 bp, Homo sapiens; identical to SEQ ID NO: 98617
  misc_feature 1..30: note = chr8:125576743-125576773
  misc_feature 1..30: note = Hyper
  source 1..30: mol_type = genomic DNA

SEQ ID NO: 129996 - DNA, 51 bp, Homo sapiens; identical to SEQ ID NO: 98618
  misc_feature 1..51: note = chr8:125580647-125580698
  misc_feature 1..51: note = Hypo
  source 1..51: mol_type = genomic DNA

SEQ ID NO: 129997 - DNA, 30 bp, Homo sapiens; identical to SEQ ID NO: 98619
  misc_feature 1..30: note = chr8:125618670-125618700
  misc_feature 1..30: note = Hypo
  source 1..30: mol_type = genomic DNA

SEQ ID NO: 129998 - DNA, 135 bp, Homo sapiens; identical to SEQ ID NO: 98620
  misc_feature 1..135: note = chr8:125672489-125672624
  misc_feature 1..135: note = Hyper
  source 1..135: mol_type = genomic DNA

SEQ ID NO: 129999 - DNA, 229 bp, Homo sapiens; identical to SEQ ID NO: 98621
  misc_feature 1..229: note = chr8:125680483-125680712
  misc_feature 1..229: note = Hypo
  source 1..229: mol_type = genomic DNA

SEQ ID NO: 130000 - DNA, 36 bp, Homo sapiens; identical to SEQ ID NO: 98622
  misc_feature 1..36: note = chr8:125682702-125682738
  misc_feature 1..36: note = Hypo
  source 1..36: mol_type = genomic DNA

SEQ ID NO: 130001 - DNA, 24 bp, Homo sapiens
  misc_feature 1..24: note = chr8:125739302-125739326
  misc_feature 1..24: note = Hyper
  source 1..24: mol_type = genomic DNA
cagggtgttgttccccgcccccac

SEQ ID NO: 130002 - DNA, 30 bp, Homo sapiens; identical to SEQ ID NO: 98624
  misc_feature 1..30: note = chr8:125740333-125740363
  misc_feature 1..30: note = Hyper
  source 1..30: mol_type = genomic DNA

SEQ ID NO: 130003 - DNA, 161 bp, Homo sapiens; identical to SEQ ID NO: 98625
  misc_feature 1..161: note = chr8:126044592-126044753
  misc_feature 1..161: note = Hypo
  source 1..161: mol_type = genomic DNA

SEQ ID NO: 130004 - DNA, 30 bp, Homo sapiens; identical to SEQ ID NO: 98626
  misc_feature 1..30: note = chr8:126079019-126079049
  misc_feature 1..30: note = Hypo
  source 1..30: mol_type = genomic DNA

SEQ ID NO: 130005 - DNA, 30 bp, Homo sapiens; identical to SEQ ID NO: 98627
  misc_feature 1..30: note = chr8:126156768-126156798
  misc_feature 1..30: note = Hypo
  source 1..30: mol_type = genomic DNA

SEQ ID NO: 130006 - DNA, 121 bp, Homo sapiens; identical to SEQ ID NO: 41932
  misc_feature 1..121: note = chr8:126267003-126267124
  misc_feature 1..121: note = Hypo
  source 1..121: mol_type = genomic DNA

SEQ ID NO: 130007 - DNA, 61 bp, Homo sapiens; identical to SEQ ID NO: 98629
  misc_feature 1..61: note = chr8:126284144-126284205
  misc_feature 1..61: note = Hypo
  source 1..61: mol_type = genomic DNA

SEQ ID NO: 130008 - DNA, 140 bp, Homo sapiens; identical to SEQ ID NO: 98630
  misc_feature 1..140: note = chr8:126400836-126400976
  misc_feature 1..140: note = Hyper
  source 1..140: mol_type = genomic DNA

SEQ ID NO: 130009 - DNA, 27 bp, Homo sapiens
  misc_feature 1..27: note = chr8:127089268-127089295
  misc_feature 1..27: note = Hypo
  source 1..27: mol_type = genomic DNA
atcctgggcccggcacggtggctcaca

SEQ ID NO: 130010 - DNA, 99 bp, Homo sapiens; identical to SEQ ID NO: 98634
  misc_feature 1..99: note = chr8:127305215-127305314
  misc_feature 1..99: note = Hypo
  source 1..99: mol_type = genomic DNA

SEQ ID NO: 130011 - DNA, 233 bp, Homo sapiens; identical to SEQ ID NO: 98635
  misc_feature 1..233: note = chr8:127518583-127518816
  misc_feature 1..233: note = Hypo
  source 1..233: mol_type = genomic DNA

SEQ ID NO: 130012 - DNA, 80 bp, Homo sapiens; identical to SEQ ID NO: 41935
  misc_feature 1..80: note = chr8:128745542-128745622
  misc_feature 1..80: note = Hypo
  source 1..80: mol_type = genomic DNA

SEQ ID NO: 130013 - DNA, 41 bp, Homo sapiens; identical to SEQ ID NO: 98647
  misc_feature 1..41: note = chr8:128861840-128861881
  misc_feature 1..41: note = Hypo
  source 1..41: mol_type = genomic DNA

SEQ ID NO: 130014 - DNA, 39 bp, Homo sapiens; identical to SEQ ID NO: 41936
  misc_feature 1..39: note = chr8:128864120-128864159
  misc_feature 1..39: note = Hypo
  source 1..39: mol_type = genomic DNA

SEQ ID NO: 130015 - DNA, 176 bp, Homo sapiens; identical to SEQ ID NO: 98649
  misc_feature 1..176: note = chr8:128872283-128872459
  misc_feature 1..176: note = Hypo
  source 1..176: mol_type = genomic DNA

SEQ ID NO: 130016 - DNA, 162 bp, Homo sapiens; identical to SEQ ID NO: 98650
  misc_feature 1..162: note = chr8:128882652-128882814
  misc_feature 1..162: note = Hypo
  source 1..162: mol_type = genomic DNA

SEQ ID NO: 130017 - DNA, 488 bp, Homo sapiens; identical to SEQ ID NO: 98651
  misc_feature 1..488: note = chr8:128888909-128889397
  misc_feature 1..488: note = Hypo
  source 1..488: mol_type = genomic DNA

SEQ ID NO: 130018 - DNA, 30 bp, Homo sapiens; identical to SEQ ID NO: 41939
  misc_feature 1..30: note = chr8:128931231-128931261
  misc_feature 1..30: note = Hypo
  source 1..30: mol_type = genomic DNA

SEQ ID NO: 130019 - DNA, 35 bp, Homo sapiens; identical to SEQ ID NO: 41940
  misc_feature 1..35: note = chr8:128962506-128962541
  misc_feature 1..35: note = Hypo
  source 1..35: mol_type = genomic DNA

SEQ ID NO: 130020 - DNA, 209 bp, Homo sapiens; identical to SEQ ID NO: 98655
  misc_feature 1..209: note = chr8:129069803-129070012
  misc_feature 1..209: note = Hypo
  source 1..209: mol_type = genomic DNA

SEQ ID NO: 130021 - DNA, 91 bp, Homo sapiens; identical to SEQ ID NO: 98656
  misc_feature 1..91: note = chr8:129355798-129355889
  misc_feature 1..91: note = Hypo
  source 1..91: mol_type = genomic DNA

SEQ ID NO: 130022 - DNA, 30 bp, Homo sapiens; identical to SEQ ID NO: 41942
  misc_feature 1..30: note = chr8:130080387-130080417
  misc_feature 1..30: note = Hypo
  source 1..30: mol_type = genomic DNA

SEQ ID NO: 130023 - DNA, 186 bp, Homo sapiens; identical to SEQ ID NO: 98666
  misc_feature 1..186: note = chr8:130116277-130116463
  misc_feature 1..186: note = Hypo
  source 1..186: mol_type = genomic DNA

SEQ ID NO: 130024 - DNA, 203 bp, Homo sapiens; identical to SEQ ID NO: 41944
  misc_feature 1..203: note = chr8:130288699-130288902
  misc_feature 1..203: note = Hypo
  source 1..203: mol_type = genomic DNA

SEQ ID NO: 130025 - DNA, 30 bp, Homo sapiens; identical to SEQ ID NO: 98669
  misc_feature 1..30: note = chr8:130305961-130305991
  misc_feature 1..30: note = Hypo
  source 1..30: mol_type = genomic DNA

SEQ ID NO: 130026 - DNA, 209 bp, Homo sapiens; identical to SEQ ID NO: 41945
  misc_feature 1..209: note = chr8:130368840-130369049
  misc_feature 1..209: note = Hypo
  source 1..209: mol_type = genomic DNA

SEQ ID NO: 130027 - DNA, 89 bp, Homo sapiens; identical to SEQ ID NO: 41946
  misc_feature 1..89: note = chr8:130369289-130369378
  misc_feature 1..89: note = Hypo
  source 1..89: mol_type = genomic DNA

SEQ ID NO: 130028 - DNA, 30 bp, Homo sapiens; identical to SEQ ID NO: 98673
  misc_feature 1..30: note = chr8:130381962-130381992
  misc_feature 1..30: note = Hypo
  source 1..30: mol_type = genomic DNA

SEQ ID NO: 130029 - DNA, 35 bp, Homo sapiens; identical to SEQ ID NO: 98674
  misc_feature 1..35: note = chr8:130461171-130461206
  misc_feature 1..35: note = Hypo
  source 1..35: mol_type = genomic DNA

SEQ ID NO: 130030 - DNA, 201 bp, Homo sapiens; identical to SEQ ID NO: 41948
  misc_feature 1..201: note = chr8:130583277-130583478
  misc_feature 1..201: note = Hypo
  source 1..201: mol_type = genomic DNA

SEQ ID NO: 130031 - DNA, 30 bp, Homo sapiens; identical to SEQ ID NO: 98680
  misc_feature 1..30: note = chr8:131046198-131046228
  misc_feature 1..30: note = Hypo
  source 1..30: mol_type = genomic DNA

SEQ ID NO: 130032 - DNA, 30 bp, Homo sapiens; identical to SEQ ID NO: 98681
  misc_feature 1..30: note = chr8:131278061-131278091
  misc_feature 1..30: note = Hypo
  source 1..30: mol_type = genomic DNA

SEQ ID NO: 130033 - DNA, 1028 bp, Homo sapiens; identical to SEQ ID NO: 98683
  misc_feature 1..1028: note = chr8:131455184-131456212
  misc_feature 1..1028: note = Hyper
  source 1..1028: mol_type = genomic DNA

SEQ ID NO: 130034 - DNA, 18 bp, Homo sapiens
  misc_feature 1..18: note = chr8:131922190-131922208
  misc_feature 1..18: note = Hypo
  source 1..18: mol_type = genomic DNA
tttttttttttgagacgg

SEQ ID NO: 130035 - DNA, 2895 bp, Homo sapiens
  misc_feature 1..2895: note = chr8:132051903-132054798
  misc_feature 1..2895: note = Hyper
  source 1..2895: mol_type = genomic DNA
tcactacctcaatgccggtgaagaagcccagcaggatgcccttgagcgggtccatgggggccgaggccaggctcaagtgtaggaccaagagagtgagtttggtcagcacgtccagcacgttcatcaccacttccgatttgcgcctttggcccaagaaatagcgctggtagaggcgttccaaatcccgagatttgaaggagttgcgcagggtggggaaaatgacccctcggtagctatagcccccattaagaaagaaatccgagttgctaggggcacagtcaaggtgcaggaagcccaggtcgcccccgcctccgctgccgctggcactgccgctcccgctgcgttccgggaagactttggtgccgcaggtgctgtgcgctcgctctcccgggcccagcgagtagaggggcagcgccgagtcgcctgacagctgcggcgcgtggtggttggggccgccgcccgcagggtccgaggctttgcccgagcctccactcccgctgccgctgcctccccggtgcccgtgaatgaagcgctgctccgtgatgtgtcgcaccgccgtctgccacagcagccgctgcggccgggaggcgctcctgccgtcgccggccgggggcgtcgggtggatggtgtagagttcctcgctgcctgtaaggcagcgcacatcggagagctccatggctctgggccgcagggaaggaggcccagaaccttggggaggcagccggaggaggggttcctaaagactcaaaggcggcctggtaggagcttggcaaggatcctttttatcctaggctgccccgttgcaggagccctgcgctagggctccctgtaggtcgggtcatactgtgcccaggggcaaagggcacctggaagatcgcggcggacctcggcgtccttgcgtgctgctctcccgccagccggcgcagcttgggtacgcagcggcagtggctatttgtcctcaggagccgcagcgctgtgagccacgcagccccttcctgggctcaggctccttggttgattctaggctcagcgttttggcgcagcctttgctctccaagagacgcctaagcgcctgggcgccgtgcttctgctgcgcgtcgggcgggtcctggctgctgcactgggctttggacgcccactgctccgcggctgcagggggcctggccggcggtgaccggcggcagcgatgggtgcgaagttagcagatgtggctggaatcatcgcccttcggagaactccattgcgccgggatggggagcaggggcggagctgggggcgggggcaaagaaggaggaggagggggtcacggtgaggtggcggggcgccccgcgacagggttggagaggtggtagcctcggcgctaacaattcaccaaatagttaatttggaggaaggggtatgctgaggctccctcctaggctctttcctagttcgggagcaaggactgacagcgcagcgctggctctggccagaagcatccctcccggagggggtgtggggactctcgctccagggtcccagcctgagctataagacgaggtcaacgctttcagctgtgctttcgaagggtcgcagcacacagttctcatcccctttatttcgttctttggagtccatttggctcggagctaggaggatcaggagaggcgggggaaggaaaaagtggtgagggctccaaagccaagagctccgagaacgaagagaagccgccggtgcggatatctgaggctgagaaccgaagcttggcggatgaggcgaaggtttggaggagaagggaggcccgaggccgcgtggaagtcgacagagacgcctctggatctagggaagcgccgccgcgtgccaccctggagctctgaaacgcaccgcgggcgccaggcgactgggagaaatttggagacctgtcagagtggtcagacacccgcggtgacttaaacccgcccccgcgccaagccacgcccccggaaccgggccgggggtggcggagggacctgccatccagatctggccaggacgccccaggtcttgtaggcagaggcacgcgcgggccggcgtgggagaggaccactgagggctagggccggcgggcgcccccggccttccctgggcgcactgcgatccagcgttccagctggccgcgccagccggttcctccgctgttcttttttaggcattggctcttgtcctctgcaggtgcggagccaggactcgtaggccgctttgcgcacggactcggagagcccagcgcgacggaatacagggtttccttttcgcccttcctacccgtgcgtcttttggcaaagccaactttcgggctaaacgcaaaatcccccaagaggccgcaatcatagaggcagtcagtttcctacaggagcctctttactacctcgatccgaagggggtggagggtacgggacatcaaaatggggacgtcccctgcctgcctcgcacactaagtttctccgcttacaatagggtcgaggaggcggacgtggagaaaggcatgtccaggggccccgcctcgccctagcccaggtttcccgcccgcccagactcagccgagcgctagcggacaaagcctgcggcggagcttgcggcggaccaagtcgctgagcggtgggagcttagtgccggtgctaatgacagatgagccgcgtcccggggtgcagggtctgcagggcaaacgcggccgccgcagtcccgcagccggatgcaggtggaggagcggtggtggtcaccacctcctccaccaagactgcggctgcagccagtggagcccgggcccagagcacagtcagctgatggccaatgacgtcaggccctgggcgcgttcgcggctccccgtggcgtcccatgaaagcccaaatgaccgccttgccttgccgccccctcagtccc

SEQ ID NO: 130036 - DNA, 30 bp, Homo sapiens; identical to SEQ ID NO: 41950
  misc_feature 1..30: note = chr8:132284091-132284121
  misc_feature 1..30: note = Hypo
  source 1..30: mol_type = genomic DNA

SEQ ID NO: 130037 - DNA, 192 bp, Homo sapiens; identical to SEQ ID NO: 98690
  misc_feature 1..192: note = chr8:132480519-132480711
  misc_feature 1..192: note = Hypo
  source 1..192: mol_type = genomic DNA

SEQ ID NO: 130038 - DNA, 30 bp, Homo sapiens; identical to SEQ ID NO: 41951
  misc_feature 1..30: note = chr8:132783128-132783158
  misc_feature 1..30: note = Hypo
  source 1..30: mol_type = genomic DNA

SEQ ID NO: 130039 - DNA, 212 bp, Homo sapiens; identical to SEQ ID NO: 98695
  misc_feature 1..212: note = chr8:132823274-132823486
  misc_feature 1..212: note = Hypo
  source 1..212: mol_type = genomic DNA

SEQ ID NO: 130040 - DNA, 50 bp, Homo sapiens; identical to SEQ ID NO: 98696
  misc_feature 1..50: note = chr8:133062815-133062865
  misc_feature 1..50: note = Hypo
  source 1..50: mol_type = genomic DNA

SEQ ID NO: 130041 - DNA, 199 bp, Homo sapiens; identical to SEQ ID NO: 98699
  misc_feature 1..199: note = chr8:133337370-133337569
  misc_feature 1..199: note = Hypo
  source 1..199: mol_type = genomic DNA

SEQ ID NO: 130042 - DNA, 30 bp, Homo sapiens; identical to SEQ ID NO: 98700
  misc_feature 1..30: note = chr8:133412585-133412615
  misc_feature 1..30: note = Hypo
  source 1..30: mol_type = genomic DNA

SEQ ID NO: 130043 - DNA, 925 bp, Homo sapiens
  misc_feature 1..925: note = chr8:133492260-133493185
  misc_feature 1..925: note = Hyper
  source 1..925: mol_type = genomic DNA
gacgggctggtctccccttcagcgggaaagcatccatgggtcttaaagccccagagacttctcagctccagccccgaccccaagtccccaagcgcgccgccgccgagggcgccccgagcggccgggtactcacaccaacgcgtggtaaagcagcgcccagccccgcggtctctccagggcgtcgtagatcaaagtttggatgcgccggtacttggcgttgtttctcttgactgggcggctcagcggggtcttggccaggagcccgatgccctgcggggtcctccgctgcccctcgtcgcggccgccgccctccagcagcagggtcccgtctttgtcggctccggccccgagcgccaaggtgacttgctccacgtcgccgggcgccagccccactttccgctcctcgtcgccggccgccgccgcgtcccctccggctgggttagccgccccgccgcctccgccgcccccgtcgccgccgccgccagccgcccccgccgccctgcgcgccttgagccccatctgcctcgcccccgccggccgcttcgccttctccgctgctgctctgggaagaaggggcgctcggggtgcgtgaacgaggcggcggcggcggctgcaagcccgggaactccaatgccatgatccgcgcgcccctccccacccccccccaaaagcaggcaaaggcgggccccctggggggcaggggaggccaggcagggggtcagggggtcacatcccgcgcgggtcagccgcaggaccccgagggtcgcgggccgggggctgcggagaagctgggagggcgcgcgaggctggcgcggaggcgctagggcgcgcggcggcgggagcctggaaccggcgctccggggcggcggcggcggcggcggcacccaggccggcgagcccaagacagcatcgcagtttatttaca

SEQ ID NO: 130044 - DNA, 276 bp, Homo sapiens
  misc_feature 1..276: note = chr8:133493495-133493771
  misc_feature 1..276: note = Hyper
  source 1..276: mol_type = genomic DNA
tgcaaccaggcagtgcgccaggcggctgcagagcccggctcctggagctcccgtgggcgttggggcttcccctggatggggcgtgacggcgggcagttgggggaagaagaggaagggaggagggactggggggttgtcgcccaccaaacattggctctgtggttgcagctttgtgaatttccctcaccccctacccctgctcctcggcttcagaggtaaaagccaagttgtcgggttggtcaaggccgggcgcaccgcgaacgcacctgctctgtg

SEQ ID NO: 130045 - DNA, 92 bp, Homo sapiens; identical to SEQ ID NO: 98704
  misc_feature 1..92: note = chr8:133686745-133686837
  misc_feature 1..92: note = Hypo
  source 1..92: mol_type = genomic DNA

SEQ ID NO: 130046 - DNA, 31 bp, Homo sapiens; identical to SEQ ID NO: 98705
  misc_feature 1..31: note = chr8:133687137-133687168
  misc_feature 1..31: note = Hypo
  source 1..31: mol_type = genomic DNA

SEQ ID NO: 130047 - DNA, 30 bp, Homo sapiens; identical to SEQ ID NO: 98706
  misc_feature 1..30: note = chr8:133728335-133728365
  misc_feature 1..30: note = Hypo
  source 1..30: mol_type = genomic DNA

SEQ ID NO: 130048 - DNA, 132 bp, Homo sapiens; identical to SEQ ID NO: 15163
  misc_feature 1..132: note = chr8:133811037-133811169
  misc_feature 1..132: note = Hypo
  source 1..132: mol_type = genomic DNA

SEQ ID NO: 130049 - DNA, 30 bp, Homo sapiens; identical to SEQ ID NO: 98709
  misc_feature 1..30: note = chr8:134018690-134018720
  misc_feature 1..30: note = Hypo
  source 1..30: mol_type = genomic DNA

SEQ ID NO: 130050 - DNA, 30 bp, Homo sapiens; identical to SEQ ID NO: 98710
  misc_feature 1..30: note = chr8:134215121-134215151
  misc_feature 1..30: note = Hypo
  source 1..30: mol_type = genomic DNA

SEQ ID NO: 130051 - DNA, 30 bp, Homo sapiens; identical to SEQ ID NO: 98713
  misc_feature 1..30: note = chr8:134262730-134262760
  misc_feature 1..30: note = Hypo
  source 1..30: mol_type = genomic DNA

SEQ ID NO: 130052 - DNA, 179 bp, Homo sapiens; identical to SEQ ID NO: 41955
  misc_feature 1..179: note = chr8:134470121-134470300
  misc_feature 1..179: note = Hypo
  source 1..179: mol_type = genomic DNA

SEQ ID NO: 130053 - DNA, 110 bp, Homo sapiens; identical to SEQ ID NO: 98715
  misc_feature 1..110: note = chr8:134471909-134472019
  misc_feature 1..110: note = Hypo
  source 1..110: mol_type = genomic DNA

SEQ ID NO: 130054 - DNA, 67 bp, Homo sapiens; identical to SEQ ID NO: 98716
  misc_feature 1..67: note = chr8:134519862-134519929
  misc_feature 1..67: note = Hypo
  source 1..67: mol_type = genomic DNA

SEQ ID NO: 130055 - DNA, 59 bp, Homo sapiens; identical to SEQ ID NO: 98717
  misc_feature 1..59: note = chr8:134521601-134521660
  misc_feature 1..59: note = Hypo
  source 1..59: mol_type = genomic DNA

SEQ ID NO: 130056 - DNA, 30 bp, Homo sapiens; identical to SEQ ID NO: 98718
  misc_feature 1..30: note = chr8:134525332-134525362
  misc_feature 1..30: note = Hypo
  source 1..30: mol_type = genomic DNA

SEQ ID NO: 130057 - DNA, 63 bp, Homo sapiens; identical to SEQ ID NO: 98719
  misc_feature 1..63: note = chr8:134541589-134541652
  misc_feature 1..63: note = Hypo
  source 1..63: mol_type = genomic DNA

SEQ ID NO: 130058 - DNA, 250 bp, Homo sapiens; identical to SEQ ID NO: 98720
  misc_feature 1..250: note = chr8:134545088-134545338
  misc_feature 1..250: note = Hypo
  source 1..250: mol_type = genomic DNA

SEQ ID NO: 130059 - DNA, 30 bp, Homo sapiens; identical to SEQ ID NO: 98721
  misc_feature 1..30: note = chr8:134566350-134566380
  misc_feature 1..30: note = Hypo
  source 1..30: mol_type = genomic DNA

SEQ ID NO: 130060 - DNA, 30 bp, Homo sapiens; identical to SEQ ID NO: 98722
  misc_feature 1..30: note = chr8:134566647-134566677
  misc_feature 1..30: note = Hypo
  source 1..30: mol_type = genomic DNA

SEQ ID NO: 130061 - DNA, 50 bp, Homo sapiens; identical to SEQ ID NO: 98723
  misc_feature 1..50: note = chr8:134581243-134581293
  misc_feature 1..50: note = Hyper
  source 1..50: mol_type = genomic DNA

SEQ ID NO: 130062 - DNA, 120 bp, Homo sapiens; identical to SEQ ID NO: 98724
  misc_feature 1..120: note = chr8:134583173-134583293
  misc_feature 1..120: note = Hyper
  source 1..120: mol_type = genomic DNA

SEQ ID NO: 130063 - DNA, 66 bp, Homo sapiens; identical to SEQ ID NO: 98725
  misc_feature 1..66: note = chr8:134585014-134585080
  misc_feature 1..66: note = Hyper
  source 1..66: mol_type = genomic DNA

SEQ ID NO: 130064 - DNA, 21 bp, Homo sapiens
  misc_feature 1..21: note = chr8:134724787-134724808
  misc_feature 1..21: note = Hypo
  source 1..21: mol_type = genomic DNA
ccaccgcgcccgtcctctgaa

SEQ ID NO: 130065 - DNA, 34 bp, Homo sapiens; identical to SEQ ID NO: 41957
  misc_feature 1..34: note = chr8:135301251-135301285
  misc_feature 1..34: note = Hypo
  source 1..34: mol_type = genomic DNA

SEQ ID NO: 130066 - DNA, 30 bp, Homo sapiens; identical to SEQ ID NO: 98728
  misc_feature 1..30: note = chr8:135319421-135319451
  misc_feature 1..30: note = Hypo
  source 1..30: mol_type = genomic DNA

SEQ ID NO: 130067 - DNA, 23 bp, Homo sapiens
  misc_feature 1..23: note = chr8:135477507-135477530
  misc_feature 1..23: note = Hypo
  source 1..23: mol_type = genomic DNA
ggagtactcgccctgcagtactt

SEQ ID NO: 130068 - DNA, 128 bp, Homo sapiens; identical to SEQ ID NO: 98730
  misc_feature 1..128: note = chr8:135732756-135732884
  misc_feature 1..128: note = Hyper
  source 1..128: mol_type = genomic DNA

SEQ ID NO: 130069 - DNA, 18 bp, Homo sapiens
  misc_feature 1..18: note = chr8:135950097-135950115
  misc_feature 1..18: note = Hypo
  source 1..18: mol_type = genomic DNA
aaccgaaaaaacaaataa

SEQ ID NO: 130070 - DNA, 230 bp, Homo sapiens; identical to SEQ ID NO: 98733
  misc_feature 1..230: note = chr8:136469072-136469302
  misc_feature 1..230: note = Hyper
  source 1..230: mol_type = genomic DNA

SEQ ID NO: 130071 - DNA, 158 bp, Homo sapiens; identical to SEQ ID NO: 98734
  misc_feature 1..158: note = chr8:136470155-136470313
  misc_feature 1..158: note = Hyper
  source 1..158: mol_type = genomic DNA

SEQ ID NO: 130072 - DNA, 19 bp, Homo sapiens
  misc_feature 1..19: note = chr8:136858149-136858168
  misc_feature 1..19: note = Hypo
  source 1..19: mol_type = genomic DNA
gatggctgggagtggcggc

SEQ ID NO: 130073 - DNA, 23 bp, Homo sapiens
  misc_feature 1..23: note = chr8:136865750-136865773
  misc_feature 1..23: note = Hypo
  source 1..23: mol_type = genomic DNA
ttcctattcggccatctataatt

SEQ ID NO: 130074 - DNA, 30 bp, Homo sapiens; identical to SEQ ID NO: 98738
  misc_feature 1..30: note = chr8:137746178-137746208
  misc_feature 1..30: note = Hypo
  source 1..30: mol_type = genomic DNA

SEQ ID NO: 130075 - DNA, 27 bp, Homo sapiens
  misc_feature 1..27: note = chr8:138625594-138625621
  misc_feature 1..27: note = Hypo
  source 1..27: mol_type = genomic DNA
tctttaaaactgatacgtggggctggg

SEQ ID NO: 130076 - DNA, 18 bp, Homo sapiens
  misc_feature 1..18: note = chr8:138909127-138909145
  misc_feature 1..18: note = Hypo
  source 1..18: mol_type = genomic DNA
ctacaaggactcattcgt

SEQ ID NO: 130077 - DNA, 154 bp, Homo sapiens; identical to SEQ ID NO: 41958
  misc_feature 1..154: note = chr8:138910227-138910381
  misc_feature 1..154: note = Hypo
  source 1..154: mol_type = genomic DNA

SEQ ID NO: 130078 - DNA, 99 bp, Homo sapiens; identical to SEQ ID NO: 98743
  misc_feature 1..99: note = chr8:139046831-139046930
  misc_feature 1..99: note = Hypo
  source 1..99: mol_type = genomic DNA

SEQ ID NO: 130079 - DNA, 30 bp, Homo sapiens; identical to SEQ ID NO: 98744
  misc_feature 1..30: note = chr8:139155605-139155635
  misc_feature 1..30: note = Hypo
  source 1..30: mol_type = genomic DNA

SEQ ID NO: 130080 - DNA, 599 bp, Homo sapiens
  misc_feature 1..599: note = chr8:139508757-139509356
  misc_feature 1..599: note = Hyper
  source 1..599: mol_type = genomic DNA
gagactggggaaaatcgagggagataaaccacattttgcggcggaatcgctgttccgtgacagaaagccatccaactggcaaccacgcttgcagaagcgtcactaccaccgacgagagagttttgcagctgccgaccccgaagcgctctcacctacctgtctccactgcagggctcccctctctctcccccgggggccgcgctcctgggtccctctctctcctctttcgccgtctctggccgccaacagttgcggcggcggcggcggcgggcggactggggagtccgcagcacctgcgagctggtgttgggtccccgcggcgaggctgcctggaggaggagcgagcggatgctgccctcgcccgccgccgccggtgctgatgcggttgctatggttatggaaccccgcaactgcccccctctccgtgcaacagctgcccggccgcggcctccgggcagccccagcgagcaggcgccaggacgcgaggctgtcagcgcggtcgggggaacgcagccgccagcgccgcaagaaagcaaggaccgaccggctgcgcccgcgccgctgggctggcgcctcccgggctgcgctcacctctggcg

SEQ ID NO: 130081 - DNA, 284 bp, Homo sapiens
  misc_feature 1..284: note = chr8:139509651-139509935
  misc_feature 1..284: note = Hyper
  source 1..284: mol_type = genomic DNA
ccctcccagactgaccggcgcgagcatgctcagtccccgcggcggggctcccctctcgagccaagaccccaggcctcgggcaggaaaagggtccctgcagatatccgggggcggggcgcggcggagaactggctgggaggggactgttgaacttggaagagaagcccaggcaacaagtagatgcctgagaaagggtaaaagcgctgagcaacccatacctccaatgcgaagtcagcagtggccttcaaccagccagccggcccgtcatccgatgggctcctcac

SEQ ID NO: 130082 - DNA, 220 bp, Homo sapiens; identical to SEQ ID NO: 98748
  misc_feature 1..220: note = chr8:139667039-139667259
  misc_feature 1..220: note = Hypo
  source 1..220: mol_type = genomic DNA

SEQ ID NO: 130083 - DNA, 30 bp, Homo sapiens; identical to SEQ ID NO: 98749
  misc_feature 1..30: note = chr8:139894041-139894071
  misc_feature 1..30: note = Hypo
  source 1..30: mol_type = genomic DNA

SEQ ID NO: 130084 - DNA, 37 bp, Homo sapiens; identical to SEQ ID NO: 98750
  misc_feature 1..37: note = chr8:139908925-139908962
  misc_feature 1..37: note = Hypo
  source 1..37: mol_type = genomic DNA

SEQ ID NO: 130085 - DNA, 40 bp, Homo sapiens; identical to SEQ ID NO: 98751
  misc_feature 1..40: note = chr8:139926210-139926250
  misc_feature 1..40: note = Hyper
  source 1..40: mol_type = genomic DNA

SEQ ID NO: 130086 - DNA, 275 bp, Homo sapiens; identical to SEQ ID NO: 98752
  misc_feature 1..275: note = chr8:139926455-139926730
  misc_feature 1..275: note = Hyper
  source 1..275: mol_type = genomic DNA

SEQ ID NO: 130087 - DNA, 207 bp, Homo sapiens; identical to SEQ ID NO: 98754
  misc_feature 1..207: note = chr8:140417247-140417454
  misc_feature 1..207: note = Hypo
  source 1..207: mol_type = genomic DNA

SEQ ID NO: 130088 - DNA, 30 bp, Homo sapiens; identical to SEQ ID NO: 98755
  misc_feature 1..30: note = chr8:140616896-140616926
  misc_feature 1..30: note = Hypo
  source 1..30: mol_type = genomic DNA

SEQ ID NO: 130089 - DNA, 114 bp, Homo sapiens; identical to SEQ ID NO: 98756
  misc_feature 1..114: note = chr8:140630523-140630637
  misc_feature 1..114: note = Hypo
  source 1..114: mol_type = genomic DNA

SEQ ID NO: 130090 - DNA, 30 bp, Homo sapiens; identical to SEQ ID NO: 41959
  misc_feature 1..30: note = chr8:140630956-140630986
  misc_feature 1..30: note = Hypo
  source 1..30: mol_type = genomic DNA

SEQ ID NO: 130091 - DNA, 106 bp, Homo sapiens; identical to SEQ ID NO: 98758
  misc_feature 1..106: note = chr8:140643342-140643448
  misc_feature 1..106: note = Hyper
  source 1..106: mol_type = genomic DNA

SEQ ID NO: 130092 - DNA, 30 bp, Homo sapiens; identical to SEQ ID NO: 98759
  misc_feature 1..30: note = chr8:140657025-140657055
  misc_feature 1..30: note = Hypo
  source 1..30: mol_type = genomic DNA

SEQ ID NO: 130093 - DNA, 37 bp, Homo sapiens; identical to SEQ ID NO: 41960
  misc_feature 1..37: note = chr8:140691457-140691494
  misc_feature 1..37: note = Hypo
  source 1..37: mol_type = genomic DNA

SEQ ID NO: 130094 - DNA, 1904 bp, Homo sapiens
  misc_feature 1..1904: note = chr8:140714444-140716348
  misc_feature 1..1904: note = Hyper
  source 1..1904: mol_type = genomic DNA
ggggcccaggggctacggagggtcagtgcctctcacgccccaggcgcactcccctgccacctgagtccctctaggagccatgggtgccaggccagccctctccaactcccagagaggtagtaagtgtaaggctcagagccccgcgcagcccagcccgcgccggggcggtgggtgggtgggtgtctgctatgggattattcttagcgctccactctcttcgcaaaagtggcgcctccgccctcccggctcaggcacactcgctcggggctcgcacgcccggcccagacaccagcgcggtggagagcaccgggtggggtccccgaagggtgaggctcggaggcgccgcggagggggggctccctagagaggagggggcgctgcgggaaggcccccaagggaggctgcgtttaaccctcgacgccctgcacccagcccggcgcggcgcgctcagccgcctccccggactcctcccggggcgcgggagcccagcggcgcgcccagcccttacctatggtggtgatgaccgtgatcgcaaagtagaaggagccggcgaatttccactggacgccggcgcggtgcggttccgactgcaggatcaccagctccagctgccggtagtcctcgctgctgatgttgtacttccccttgatccggatctcctcggctttgagtttctcctcctcgcgcatctcgtggtccgactcgagggcgtcgaacacggcggcgcccaccagcaggtaggtgaaggtgcagacgatgagggacagagtccgcacgttctgcctcttcatggccgccagcaaggagccggcgcggggggcatgtcccgcaggctcacagccgcgcgcgtcccactgcagcgcccggcggccgccgccgcctcctcctccgccgccgccgccgccgcctccaagttgtaagcggcggcggcagcagcagcagcagcagcggggaggcggggggcggggaggctggggggggccccctccgctggggccgccacagccaccgccaccgcgaggcggctggcggggcaggggcggcgcgggcccgggctcagccgagaaggcggacaggcacaggaggctgctcgagcgccggggccaggcgtccgggaaccccgacaccctgcgccagacccggccgaagcagcccgccccactgcgcagggccatgcagggcggccccgctgggtaccgcgcgggccttgctgccctccgcaccccgccccccgctcccgcgggaaacgcagggacgggaaccggagccagaaagcggccggagggcggccgcggggcccggtacccctgtgggtccagctcgcgggtggcggtgcccagcaaggagcctgcaggtccgcgcgcccagcggaacctgcttccccttttacccctcctcgccccctctcggtggtggggaggaaaagtttgcgaagtggcggtgtctctggagtcccctgcaagcggggagggggccgagcaggtgcagcgggaggggcagcccgctccccaaaggtccgcgcgcccagcgcccacccgggcgcgcgggtgcgcagcggggtccccgccgggcgtcggccggtgcgcgaagtttgctcggctcaacccccaaggcgcgggagcggggcgcggccccaggacggcagggaccgcgatggagcggcttcgggggcggccgggggacggcgcggtggcggtcggccagcccgctcctccgggggcggcgggcgcggcggcggcggcgggaggggtcccgcgggcctcgcggagcagcggggcggacgcgggcgcatgagccgcgcgggggtcggggccctccggcgtccgggcgtcccgggaggcggccgccgcgctggtctgccccgggcgctacgtgcgtgcgcgccgttgggagcccgaatgtgt

SEQ ID NO: 130095 - DNA, 44 bp, Homo sapiens; identical to SEQ ID NO: 98765
  misc_feature 1..44: note = chr8:140716408-140716452
  misc_feature 1..44: note = Hyper
  source 1..44: mol_type = genomic DNA

SEQ ID NO: 130096 - DNA, 511 bp, Homo sapiens; identical to SEQ ID NO: 98766
  misc_feature 1..511: note = chr8:140716655-140717166
  misc_feature 1..511: note = Hyper
  source 1..511: mol_type = genomic DNA

SEQ ID NO: 130097 - DNA, 150 bp, Homo sapiens; identical to SEQ ID NO: 98767
  misc_feature 1..150: note = chr8:140717226-140717376
  misc_feature 1..150: note = Hyper
  source 1..150: mol_type = genomic DNA

SEQ ID NO: 130098 - DNA, 196 bp, Homo sapiens; identical to SEQ ID NO: 98768
  misc_feature 1..196: note = chr8:140717664-140717860
  misc_feature 1..196: note = Hyper
  source 1..196: mol_type = genomic DNA

SEQ ID NO: 130099 - DNA, 34 bp, Homo sapiens; identical to SEQ ID NO: 98769
  misc_feature 1..34: note = chr8:140751338-140751372
  misc_feature 1..34: note = Hypo
  source 1..34: mol_type = genomic DNA

SEQ ID NO: 130100 - DNA, 37 bp, Homo sapiens; identical to SEQ ID NO: 98770
  misc_feature 1..37: note = chr8:140788728-140788765
  misc_feature 1..37: note = Hypo
  source 1..37: mol_type = genomic DNA

SEQ ID NO: 130101 - DNA, 186 bp, Homo sapiens; identical to SEQ ID NO: 98771
  misc_feature 1..186: note = chr8:140818684-140818870
  misc_feature 1..186: note = Hypo
  source 1..186: mol_type = genomic DNA

SEQ ID NO: 130102 - DNA, 281 bp, Homo sapiens; identical to SEQ ID NO: 98772
  misc_feature 1..281: note = chr8:140834115-140834396
  misc_feature 1..281: note = Hypo
  source 1..281: mol_type = genomic DNA

SEQ ID NO: 130103 - DNA, 140 bp, Homo sapiens; identical to SEQ ID NO: 98773
  misc_feature 1..140: note = chr8:140834841-140834981
  misc_feature 1..140: note = Hypo
  source 1..140: mol_type = genomic DNA

SEQ ID NO: 130104 - DNA, 30 bp, Homo sapiens; identical to SEQ ID NO: 98774
  misc_feature 1..30: note = chr8:140869275-140869305
  misc_feature 1..30: note = Hypo
  source 1..30: mol_type = genomic DNA

SEQ ID NO: 130105 - DNA, 30 bp, Homo sapiens; identical to SEQ ID NO: 98775
  misc_feature 1..30: note = chr8:140869920-140869950
  misc_feature 1..30: note = Hypo
  source 1..30: mol_type = genomic DNA

SEQ ID NO: 130106 - DNA, 315 bp, Homo sapiens; identical to SEQ ID NO: 98776
  misc_feature 1..315: note = chr8:140963081-140963396
  misc_feature 1..315: note = Hypo
  source 1..315: mol_type = genomic DNA

SEQ ID NO: 130107 - DNA, 30 bp, Homo sapiens; identical to SEQ ID NO: 98777
  misc_feature 1..30: note = chr8:140971345-140971375
  misc_feature 1..30: note = Hypo
  source 1..30: mol_type = genomic DNA

SEQ ID NO: 130108 - DNA, 30 bp, Homo sapiens; identical to SEQ ID NO: 41964
  misc_feature 1..30: note = chr8:141018127-141018157
  misc_feature 1..30: note = Hypo
  source 1..30: mol_type = genomic DNA

SEQ ID NO: 130109 - DNA, 30 bp, Homo sapiens; identical to SEQ ID NO: 41965
  misc_feature 1..30: note = chr8:141054547-141054577
  misc_feature 1..30: note = Hypo
  source 1..30: mol_type = genomic DNA

SEQ ID NO: 130110 - DNA, 41 bp, Homo sapiens; identical to SEQ ID NO: 41966
  misc_feature 1..41: note = chr8:141106960-141107001
  misc_feature 1..41: note = Hypo
  source 1..41: mol_type = genomic DNA

SEQ ID NO: 130111 - DNA, 323 bp, Homo sapiens; identical to SEQ ID NO: 98781
  misc_feature 1..323: note = chr8:141107540-141107863
  misc_feature 1..323: note = Hypo
  source 1..323: mol_type = genomic DNA

SEQ ID NO: 130112 - DNA, 30 bp, Homo sapiens; identical to SEQ ID NO: 98782
  misc_feature 1..30: note = chr8:141126859-141126889
  misc_feature 1..30: note = Hypo
  source 1..30: mol_type = genomic DNA

SEQ ID NO: 130113 - DNA, 30 bp, Homo sapiens; identical to SEQ ID NO: 98783
  misc_feature 1..30: note = chr8:141159257-141159287
  misc_feature 1..30: note = Hypo
  source 1..30: mol_type = genomic DNA

SEQ ID NO: 130114 - DNA, 203 bp, Homo sapiens; identical to SEQ ID NO: 98784
  misc_feature 1..203: note = chr8:141159746-141159949
  misc_feature 1..203: note = Hypo
  source 1..203: mol_type = genomic DNA

SEQ ID NO: 130115 - DNA, 284 bp, Homo sapiens; identical to SEQ ID NO: 98785
  misc_feature 1..284: note = chr8:141202454-141202738
  misc_feature 1..284: note = Hypo
  source 1..284: mol_type = genomic DNA

SEQ ID NO: 130116 - DNA, 30 bp, Homo sapiens; identical to SEQ ID NO: 98786
  misc_feature 1..30: note = chr8:141219253-141219283
  misc_feature 1..30: note = Hypo
  source 1..30: mol_type = genomic DNA

SEQ ID NO: 130117 - DNA, 70 bp, Homo sapiens; identical to SEQ ID NO: 98787
  misc_feature 1..70: note = chr8:141249551-141249621
  misc_feature 1..70: note = Hypo
  source 1..70: mol_type = genomic DNA

SEQ ID NO: 130118 - DNA, 113 bp, Homo sapiens; identical to SEQ ID NO: 98788
  misc_feature 1..113: note = chr8:141347719-141347832
  misc_feature 1..113: note = Hypo
  source 1..113: mol_type = genomic DNA

SEQ ID NO: 130119 - DNA, 196 bp, Homo sapiens; identical to SEQ ID NO: 41971
  misc_feature 1..196: note = chr8:141466557-141466753
  misc_feature 1..196: note = Hypo
  source 1..196: mol_type = genomic DNA

SEQ ID NO: 130120 - DNA, 30 bp, Homo sapiens; identical to SEQ ID NO: 98790
  misc_feature 1..30: note = chr8:141503865-141503895
  misc_feature 1..30: note = Hypo
  source 1..30: mol_type = genomic DNA

SEQ ID NO: 130121 - DNA, 30 bp, Homo sapiens; identical to SEQ ID NO: 98791
  misc_feature 1..30: note = chr8:141559694-141559724
  misc_feature 1..30: note = Hypo
  source 1..30: mol_type = genomic DNA

SEQ ID NO: 130122 - DNA, 215 bp, Homo sapiens; identical to SEQ ID NO: 98792
  misc_feature 1..215: note = chr8:141566731-141566946
  misc_feature 1..215: note = Hypo
  source 1..215: mol_type = genomic DNA

SEQ ID NO: 130123 - DNA, 80 bp, Homo sapiens; identical to SEQ ID NO: 98793
  misc_feature 1..80: note = chr8:141577436-141577516
  misc_feature 1..80: note = Hypo
  source 1..80: mol_type = genomic DNA

SEQ ID NO: 130124 - DNA, 171 bp, Homo sapiens; identical to SEQ ID NO: 98794
  misc_feature 1..171: note = chr8:141588008-141588179
  misc_feature 1..171: note = Hypo
  source 1..171: mol_type = genomic DNA

SEQ ID NO: 130125 - DNA, 30 bp, Homo sapiens; identical to SEQ ID NO: 98795
  misc_feature 1..30: note = chr8:141594621-141594651
  misc_feature 1..30: note = Hypo
  source 1..30: mol_type = genomic DNA

SEQ ID NO: 130126 - DNA, 55 bp, Homo sapiens; identical to SEQ ID NO: 98796
  misc_feature 1..55: note = chr8:141594857-141594912
  misc_feature 1..55: note = Hypo
  source 1..55: mol_type = genomic DNA

SEQ ID NO: 130127 - DNA, 368 bp, Homo sapiens; identical to SEQ ID NO: 98797
  misc_feature 1..368: note = chr8:141596819-141597187
  misc_feature 1..368: note = Hypo
  source 1..368: mol_type = genomic DNA

SEQ ID NO: 130128 - DNA, 30 bp, Homo sapiens; identical to SEQ ID NO: 98798
  misc_feature 1..30: note = chr8:141598051-141598081
  misc_feature 1..30: note = Hypo
  source 1..30: mol_type = genomic DNA

SEQ ID NO: 130129 - DNA, 30 bp, Homo sapiens; identical to SEQ ID NO: 98799
  misc_feature 1..30: note = chr8:141599723-141599753
  misc_feature 1..30: note = Hypo
  source 1..30: mol_type = genomic DNA

SEQ ID NO: 130130 - DNA, 109 bp, Homo sapiens; identical to SEQ ID NO: 98800
  misc_feature 1..109: note = chr8:141600175-141600284
  misc_feature 1..109: note = Hypo
  source 1..109: mol_type = genomic DNA

SEQ ID NO: 130131 - DNA, 52 bp, Homo sapiens; identical to SEQ ID NO: 98801
  misc_feature 1..52: note = chr8:141602350-141602402
  misc_feature 1..52: note = Hypo
  source 1..52: mol_type = genomic DNA

SEQ ID NO: 130132 - DNA, 38 bp, Homo sapiens; identical to SEQ ID NO: 98802
  misc_feature 1..38: note = chr8:141624393-141624431
  misc_feature 1..38: note = Hypo
  source 1..38: mol_type = genomic DNA

SEQ ID NO: 130133 - DNA, 32 bp, Homo sapiens; identical to SEQ ID NO: 98803
  misc_feature 1..32: note = chr8:141629973-141630005
  misc_feature 1..32: note = Hypo
  source 1..32: mol_type = genomic DNA

SEQ ID NO: 130134 - DNA, 53 bp, Homo sapiens; identical to SEQ ID NO: 98804
  misc_feature 1..53: note = chr8:141632257-141632310
  misc_feature 1..53: note = Hypo
  source 1..53: mol_type = genomic DNA

SEQ ID NO: 130135 - DNA, 40 bp, Homo sapiens; identical to SEQ ID NO: 98805
  misc_feature 1..40: note = chr8:141633613-141633653
  misc_feature 1..40: note = Hypo
  source 1..40: mol_type = genomic DNA

SEQ ID NO: 130136 - DNA, 68 bp, Homo sapiens; identical to SEQ ID NO: 98806
  misc_feature 1..68: note = chr8:141634252-141634320
  misc_feature 1..68: note = Hypo
  source 1..68: mol_type = genomic DNA

SEQ ID NO: 130137 - DNA, 30 bp, Homo sapiens; identical to SEQ ID NO: 98807
  misc_feature 1..30: note = chr8:141638210-141638240
  misc_feature 1..30: note = Hypo
  source 1..30: mol_type = genomic DNA

SEQ ID NO: 130138 - DNA, 30 bp, Homo sapiens; identical to SEQ ID NO: 98809
  misc_feature 1..30: note = chr8:142095370-142095400
  misc_feature 1..30: note = Hypo
  source 1..30: mol_type = genomic DNA

SEQ ID NO: 130139 - DNA, 94 bp, Homo sapiens; identical to SEQ ID NO: 98810
  misc_feature 1..94: note = chr8:142119106-142119200
  misc_feature 1..94: note = Hypo
  source 1..94: mol_type = genomic DNA

SEQ ID NO: 130140 - DNA, 30 bp, Homo sapiens; identical to SEQ ID NO: 98811
  misc_feature 1..30: note = chr8:142168132-142168162
  misc_feature 1..30: note = Hypo
  source 1..30: mol_type = genomic DNA

SEQ ID NO: 130141 - DNA, 30 bp, Homo sapiens; identical to SEQ ID NO: 98812
  misc_feature 1..30: note = chr8:142190839-142190869
  misc_feature 1..30: note = Hypo
  source 1..30: mol_type = genomic DNA

SEQ ID NO: 130142 - DNA, 54 bp, Homo sapiens; identical to SEQ ID NO: 98813
  misc_feature 1..54: note = chr8:142231648-142231702
  misc_feature 1..54: note = Hypo
  source 1..54: mol_type = genomic DNA

SEQ ID NO: 130143 - DNA, 176 bp, Homo sapiens; identical to SEQ ID NO: 98814
  misc_feature 1..176: note = chr8:142242938-142243114
  misc_feature 1..176: note = Hypo
  source 1..176: mol_type = genomic DNA

SEQ ID NO: 130144 - DNA, 266 bp, Homo sapiens; identical to SEQ ID NO: 98815
  misc_feature 1..266: note = chr8:142243948-142244214
  misc_feature 1..266: note = Hypo
  source 1..266: mol_type = genomic DNA

SEQ ID NO: 130145 - DNA, 30 bp, Homo sapiens; identical to SEQ ID NO: 98816
  misc_feature 1..30: note = chr8:142260889-142260919
  misc_feature 1..30: note = Hypo
  source 1..30: mol_type = genomic DNA

SEQ ID NO: 130146 - DNA, 95 bp, Homo sapiens; identical to SEQ ID NO: 98817
  misc_feature 1..95: note = chr8:142290791-142290886
  misc_feature 1..95: note = Hypo
  source 1..95: mol_type = genomic DNA

SEQ ID NO: 130147 - DNA, 151 bp, Homo sapiens; identical to SEQ ID NO: 98818
  misc_feature 1..151: note = chr8:142292552-142292703
  misc_feature 1..151: note = Hypo
  source 1..151: mol_type = genomic DNA

SEQ ID NO: 130148 - DNA, 30 bp, Homo sapiens; identical to SEQ ID NO: 98819
  misc_feature 1..30: note = chr8:142296602-142296632
  misc_feature 1..30: note = Hypo
  source 1..30: mol_type = genomic DNA

SEQ ID NO: 130149 - DNA, 43 bp, Homo sapiens; identical to SEQ ID NO: 98820
  misc_feature 1..43: note = chr8:142297555-142297598
  misc_feature 1..43: note = Hypo
  source 1..43: mol_type = genomic DNA

SEQ ID NO: 130150 - DNA, 245 bp, Homo sapiens; identical to SEQ ID NO: 98821
  misc_feature 1..245: note = chr8:142299062-142299307
  misc_feature 1..245: note = Hypo
  source 1..245: mol_type = genomic DNA

SEQ ID NO: 130151 - DNA, 26 bp, Homo sapiens
  misc_feature 1..26: note = chr8:142313508-142313534
  misc_feature 1..26: note = Hypo
  source 1..26: mol_type = genomic DNA
gattgcaggaacgagcctctgtgccc

SEQ ID NO: 130152 - DNA, 30 bp, Homo sapiens; identical to SEQ ID NO: 41984
  misc_feature 1..30: note = chr8:142323052-142323082
  misc_feature 1..30: note = Hypo
  source 1..30: mol_type = genomic DNA

SEQ ID NO: 130153 - DNA, 30 bp, Homo sapiens; identical to SEQ ID NO: 98824
  misc_feature 1..30: note = chr8:142356494-142356524
  misc_feature 1..30: note = Hypo
  source 1..30: mol_type = genomic DNA

SEQ ID NO: 130154 - DNA, 162 bp, Homo sapiens; identical to SEQ ID NO: 98825
  misc_feature 1..162: note = chr8:142361169-142361331
  misc_feature 1..162: note = Hypo
  source 1..162: mol_type = genomic DNA

SEQ ID NO: 130155 - DNA, 64 bp, Homo sapiens; identical to SEQ ID NO: 98827
  misc_feature 1..64: note = chr8:142367760-142367824
  misc_feature 1..64: note = Hypo
  source 1..64: mol_type = genomic DNA

SEQ ID NO: 130156 - DNA, 30 bp, Homo sapiens; identical to SEQ ID NO: 98828
  misc_feature 1..30: note = chr8:142368111-142368141
  misc_feature 1..30: note = Hypo
  source 1..30: mol_type = genomic DNA

SEQ ID NO: 130157 - DNA, 30 bp, Homo sapiens; identical to SEQ ID NO: 98829
  misc_feature 1..30: note = chr8:142369212-142369242
  misc_feature 1..30: note = Hyper
  source 1..30: mol_type = genomic DNA

SEQ ID NO: 130158 - DNA, 30 bp, Homo sapiens; identical to SEQ ID NO: 98830
  misc_feature 1..30: note = chr8:142405274-142405304
  misc_feature 1..30: note = Hypo
  source 1..30: mol_type = genomic DNA

SEQ ID NO: 130159 - DNA, 30 bp, Homo sapiens; identical to SEQ ID NO: 98831
  misc_feature 1..30: note = chr8:142405762-142405792
  misc_feature 1..30: note = Hypo
  source 1..30: mol_type = genomic DNA

SEQ ID NO: 130160 - DNA, 30 bp, Homo sapiens; identical to SEQ ID NO: 98832
  misc_feature 1..30: note = chr8:142419859-142419889
  misc_feature 1..30: note = Hypo
  source 1..30: mol_type = genomic DNA

SEQ ID NO: 130161 - DNA, 30 bp, Homo sapiens; identical to SEQ ID NO: 98833
  misc_feature 1..30: note = chr8:142424065-142424095
  misc_feature 1..30: note = Hypo
  source 1..30: mol_type = genomic DNA

SEQ ID NO: 130162 - DNA, 105 bp, Homo sapiens; identical to SEQ ID NO: 98834
  misc_feature 1..105: note = chr8:142427595-142427700
  misc_feature 1..105: note = Hyper
  source 1..105: mol_type = genomic DNA

SEQ ID NO: 130163 - DNA, 265 bp, Homo sapiens
  misc_feature 1..265: note = chr8:142428027-142428292
  misc_feature 1..265: note = Hyper
  source 1..265: mol_type = genomic DNA
gcggcggaggggcggcgccccgacccagggccagcaccgtgggcaccgccaggccggcgcgtatggaggcggtgggacgcctgcggcgcgggtgagcctggcaggtggggacgcggcggacccaggccttccgggaccccagccccgccggggaggaggtggcgccctccggagggctgggcgggagccccgctggcacccagggagggggccgcgccccttaccacgaccccacccgcgactggttccccgggactccccagag

SEQ ID NO: 130164 - DNA, 155 bp, Homo sapiens; identical to SEQ ID NO: 98836
  misc_feature 1..155: note = chr8:142432225-142432380
  misc_feature 1..155: note = Hypo
  source 1..155: mol_type = genomic DNA

SEQ ID NO: 130165 - DNA, 116 bp, Homo sapiens; identical to SEQ ID NO: 98837
  misc_feature 1..116: note = chr8:142436166-142436282
  misc_feature 1..116: note = Hypo
  source 1..116: mol_type = genomic DNA

SEQ ID NO: 130166 - DNA, 149 bp, Homo sapiens; identical to SEQ ID NO: 98838
  misc_feature 1..149: note = chr8:142439200-142439349
  misc_feature 1..149: note = Hypo
  source 1..149: mol_type = genomic DNA

SEQ ID NO: 130167 - DNA, 30 bp, Homo sapiens; identical to SEQ ID NO: 98839
  misc_feature 1..30: note = chr8:142444722-142444752
  misc_feature 1..30: note = Hypo
  source 1..30: mol_type = genomic DNA

SEQ ID NO: 130168 - DNA, 30 bp, Homo sapiens; identical to SEQ ID NO: 98840
  misc_feature 1..30: note = chr8:142445528-142445558
  misc_feature 1..30: note = Hypo
  source 1..30: mol_type = genomic DNA

SEQ ID NO: 130169 - DNA, 162 bp, Homo sapiens; identical to SEQ ID NO: 98841
  misc_feature 1..162: note = chr8:142452230-142452392
  misc_feature 1..162: note = Hypo
  source 1..162: mol_type = genomic DNA

SEQ ID NO: 130170 - DNA, 30 bp, Homo sapiens; identical to SEQ ID NO: 98842
  misc_feature 1..30: note = chr8:142453296-142453326
  misc_feature 1..30: note = Hypo
  source 1..30: mol_type = genomic DNA

SEQ ID NO: 130171 - DNA, 65 bp, Homo sapiens; identical to SEQ ID NO: 98843
  misc_feature 1..65: note = chr8:142461734-142461799
  misc_feature 1..65: note = Hypo
  source 1..65: mol_type = genomic DNA

SEQ ID NO: 130172 - DNA, 54 bp, Homo sapiens; identical to SEQ ID NO: 98844
  misc_feature 1..54: note = chr8:142501450-142501504
  misc_feature 1..54: note = Hypo
  source 1..54: mol_type = genomic DNA

SEQ ID NO: 130173 - DNA, 830 bp, Homo sapiens
  misc_feature 1..830: note = chr8:142528212-142529042
  misc_feature 1..830: note = Hyper
  source 1..830: mol_type = genomic DNA
ctggccacctctcttcgcgcccggcctcctggtctcccgcctgcgcgggccgctcccggccctccccgccctgccgggcgttcactgtcccctccgcccgcaggtcccgcggcgcccccggagcccgccttcccggacatctacggcggggacgcgcagctctgggaggcgcatttccgcggcatcgggcgcgcctaccgcgcgctgggcaagcaggacgacttcgccatccgcgtgctcaccgagaacttcacgctgcccttcccgttcgcctggccgccggggtccgaccccgcctgcgggccgctcttctacgacccccgcgaccgcgcagacttcgacttcctgctgcgcggccccggagcttcgcccccagcgctgctgcggcccctgcacgccacggcccaggcagcgatgcgcaagcggcgcctggagcggctggccctgagctgcgcccgcgcgcggggcccgggcccggcctcgtcctgctgctgcccggccccgccgccgccttcccggagcccgaggccagcgcttccagcgacggcacccccaggctggcccaggccccgccgctgccccgagagcgaacagaataaataaagagtttccccagctctcccgcgcccggcgcttttctgcacacactccgacaggcctgggcggctgggcccggcggggaaggggggcggtgggacggtgggacggtggaccaggaacccaactgggacaccgggccaggccgggcagcggtgggcctgggaagccgcatgggtccgaaggtgcagtgaacatattcgcagtagaaacggtgacggaggcaggccctc

SEQ ID NO: 130174 - DNA, 200 bp, Homo sapiens; identical to SEQ ID NO: 98850
  misc_feature 1..200: note = chr8:142535307-142535507
  misc_feature 1..200: note = Hypo
  source 1..200: mol_type = genomic DNA

SEQ ID NO: 130175 - DNA, 55 bp, Homo sapiens; identical to SEQ ID NO: 98851
  misc_feature 1..55: note = chr8:142547012-142547067
  misc_feature 1..55: note = Hypo
  source 1..55: mol_type = genomic DNA

SEQ ID NO: 130176 - DNA, 144 bp, Homo sapiens; identical to SEQ ID NO: 41991
  misc_feature 1..144: note = chr8:142553829-142553973
  misc_feature 1..144: note = Hypo
  source 1..144: mol_type = genomic DNA

SEQ ID NO: 130177 - DNA, 185 bp, Homo sapiens; identical to SEQ ID NO: 98853
  misc_feature 1..185: note = chr8:142558807-142558992
  misc_feature 1..185: note = Hypo
  source 1..185: mol_type = genomic DNA

SEQ ID NO: 130178 - DNA, 62 bp, Homo sapiens; identical to SEQ ID NO: 98854
  misc_feature 1..62: note = chr8:142560165-142560227
  misc_feature 1..62: note = Hypo
  source 1..62: mol_type = genomic DNA

SEQ ID NO: 130179 - DNA, 296 bp, Homo sapiens; identical to SEQ ID NO: 98855
  misc_feature 1..296: note = chr8:142568543-142568839
  misc_feature 1..296: note = Hypo
  source 1..296: mol_type = genomic DNA

SEQ ID NO: 130180 - DNA, 172 bp, Homo sapiens; identical to SEQ ID NO: 98856
  misc_feature 1..172: note = chr8:142583056-142583228
  misc_feature 1..172: note = Hypo
  source 1..172: mol_type = genomic DNA

SEQ ID NO: 130181 - DNA, 171 bp, Homo sapiens; identical to SEQ ID NO: 98857
  misc_feature 1..171: note = chr8:142593564-142593735
  misc_feature 1..171: note = Hypo
  source 1..171: mol_type = genomic DNA

SEQ ID NO: 130182 - DNA, 30 bp, Homo sapiens; identical to SEQ ID NO: 98858
  misc_feature 1..30: note = chr8:142603404-142603434
  misc_feature 1..30: note = Hypo
  source 1..30: mol_type = genomic DNA

SEQ ID NO: 130183 - DNA, 132 bp, Homo sapiens; identical to SEQ ID NO: 98859
  misc_feature 1..132: note = chr8:142622154-142622286
  misc_feature 1..132: note = Hypo
  source 1..132: mol_type = genomic DNA

SEQ ID NO: 130184 - DNA, 41 bp, Homo sapiens; identical to SEQ ID NO: 98860
  misc_feature 1..41: note = chr8:142630247-142630288
  misc_feature 1..41: note = Hypo
  source 1..41: mol_type = genomic DNA

SEQ ID NO: 130185 - DNA, 30 bp, Homo sapiens; identical to SEQ ID NO: 98861
  misc_feature 1..30: note = chr8:142633631-142633661
  misc_feature 1..30: note = Hypo
  source 1..30: mol_type = genomic DNA

SEQ ID NO: 130186 - DNA, 43 bp, Homo sapiens; identical to SEQ ID NO: 98862
  misc_feature 1..43: note = chr8:142659067-142659110
  misc_feature 1..43: note = Hypo
  source 1..43: mol_type = genomic DNA

SEQ ID NO: 130187 - DNA, 34 bp, Homo sapiens; identical to SEQ ID NO: 98863
  misc_feature 1..34: note = chr8:142680131-142680165
  misc_feature 1..34: note = Hypo
  source 1..34: mol_type = genomic DNA

SEQ ID NO: 130188 - DNA, 136 bp, Homo sapiens; identical to SEQ ID NO: 98864
  misc_feature 1..136: note = chr8:142694812-142694948
  misc_feature 1..136: note = Hypo
  source 1..136: mol_type = genomic DNA

SEQ ID NO: 130189 - DNA, 193 bp, Homo sapiens; identical to SEQ ID NO: 41998
  misc_feature 1..193: note = chr8:142706678-142706871
  misc_feature 1..193: note = Hypo
  source 1..193: mol_type = genomic DNA

SEQ ID NO: 130190 - DNA, 46 bp, Homo sapiens; identical to SEQ ID NO: 98866
  misc_feature 1..46: note = chr8:142738298-142738344
  misc_feature 1..46: note = Hypo
  source 1..46: mol_type = genomic DNA

SEQ ID NO: 130191 - DNA, 196 bp, Homo sapiens; identical to SEQ ID NO: 98867
  misc_feature 1..196: note = chr8:142841690-142841886
  misc_feature 1..196: note = Hypo
  source 1..196: mol_type = genomic DNA

SEQ ID NO: 130192 - DNA, 202 bp, Homo sapiens; identical to SEQ ID NO: 98868
  misc_feature 1..202: note = chr8:142859982-142860184
  misc_feature 1..202: note = Hypo
  source 1..202: mol_type = genomic DNA

SEQ ID NO: 130193 - DNA, 30 bp, Homo sapiens; identical to SEQ ID NO: 98869
  misc_feature 1..30: note = chr8:142881166-142881196
  misc_feature 1..30: note = Hypo
  source 1..30: mol_type = genomic DNA

SEQ ID NO: 130194 - DNA, 42 bp, Homo sapiens; identical to SEQ ID NO: 98870
  misc_feature 1..42: note = chr8:142895890-142895932
  misc_feature 1..42: note = Hypo
  source 1..42: mol_type = genomic DNA

SEQ ID NO: 130195 - DNA, 159 bp, Homo sapiens; identical to SEQ ID NO: 98871
  misc_feature 1..159: note = chr8:142939132-142939291
  misc_feature 1..159: note = Hypo
  source 1..159: mol_type = genomic DNA

SEQ ID NO: 130196 - DNA, 147 bp, Homo sapiens; identical to SEQ ID NO: 98872
  misc_feature 1..147: note = chr8:142984512-142984659
  misc_feature 1..147: note = Hypo
  source 1..147: mol_type = genomic DNA

SEQ ID NO: 130197 - DNA, 30 bp, Homo sapiens; identical to SEQ ID NO: 98873
  misc_feature 1..30: note = chr8:143013191-143013221
  misc_feature 1..30: note = Hypo
  source 1..30: mol_type = genomic DNA

SEQ ID NO: 130198 - DNA, 102 bp, Homo sapiens; identical to SEQ ID NO: 98874
  misc_feature 1..102: note = chr8:143054769-143054871
  misc_feature 1..102: note = Hypo
  source 1..102: mol_type = genomic DNA

SEQ ID NO: 130199 - DNA, 162 bp, Homo sapiens; identical to SEQ ID NO: 98875
  misc_feature 1..162: note = chr8:143054991-143055153
  misc_feature 1..162: note = Hypo
  source 1..162: mol_type = genomic DNA

SEQ ID NO: 130200 - DNA, 30 bp, Homo sapiens; identical to SEQ ID NO: 98876
  misc_feature 1..30: note = chr8:143055995-143056025
  misc_feature 1..30: note = Hypo
  source 1..30: mol_type = genomic DNA

SEQ ID NO: 130201 - DNA, 280 bp, Homo sapiens; identical to SEQ ID NO: 98877
  misc_feature 1..280: note = chr8:143088493-143088773
  misc_feature 1..280: note = Hypo
  source 1..280: mol_type = genomic DNA

SEQ ID NO: 130202 - DNA, 68 bp, Homo sapiens; identical to SEQ ID NO: 42003
  misc_feature 1..68: note = chr8:143088999-143089067
  misc_feature 1..68: note = Hypo
  source 1..68: mol_type = genomic DNA

SEQ ID NO: 130203 - DNA, 85 bp, Homo sapiens; identical to SEQ ID NO: 98879
  misc_feature 1..85: note = chr8:143090651-143090736
  misc_feature 1..85: note = Hypo
  source 1..85: mol_type = genomic DNA

SEQ ID NO: 130204 - DNA, 33 bp, Homo sapiens; identical to SEQ ID NO: 15178
  misc_feature 1..33: note = chr8:143097424-143097457
  misc_feature 1..33: note = Hypo
  source 1..33: mol_type = genomic DNA

SEQ ID NO: 130205 - DNA, 399 bp, Homo sapiens; identical to SEQ ID NO: 98881
  misc_feature 1..399: note = chr8:143105067-143105466
  misc_feature 1..399: note = Hypo
  source 1..399: mol_type = genomic DNA

SEQ ID NO: 130206 - DNA, 30 bp, Homo sapiens; identical to SEQ ID NO: 98882
  misc_feature 1..30: note = chr8:143105753-143105783
  misc_feature 1..30: note = Hypo
  source 1..30: mol_type = genomic DNA

SEQ ID NO: 130207 - DNA, 57 bp, Homo sapiens; identical to SEQ ID NO: 98883
  misc_feature 1..57: note = chr8:143128744-143128801
  misc_feature 1..57: note = Hypo
  source 1..57: mol_type = genomic DNA

SEQ ID NO: 130208 - DNA, 30 bp, Homo sapiens; identical to SEQ ID NO: 42008
  misc_feature 1..30: note = chr8:143156215-143156245
  misc_feature 1..30: note = Hypo
  source 1..30: mol_type = genomic DNA

SEQ ID NO: 130209 - DNA, 30 bp, Homo sapiens; identical to SEQ ID NO: 98885
  misc_feature 1..30: note = chr8:143162428-143162458
  misc_feature 1..30: note = Hypo
  source 1..30: mol_type = genomic DNA

SEQ ID NO: 130210 - DNA, 150 bp, Homo sapiens; identical to SEQ ID NO: 98886
  misc_feature 1..150: note = chr8:143171132-143171282
  misc_feature 1..150: note = Hypo
  source 1..150: mol_type = genomic DNA

SEQ ID NO: 130211 - DNA, 30 bp, Homo sapiens; identical to SEQ ID NO: 98887
  misc_feature 1..30: note = chr8:143193094-143193124
  misc_feature 1..30: note = Hypo
  source 1..30: mol_type = genomic DNA

SEQ ID NO: 130212 - DNA, 157 bp, Homo sapiens; identical to SEQ ID NO: 98888
  misc_feature 1..157: note = chr8:143198927-143199084
  misc_feature 1..157: note = Hypo
  source 1..157: mol_type = genomic DNA

SEQ ID NO: 130213 - DNA, 30 bp, Homo sapiens; identical to SEQ ID NO: 98889
  misc_feature 1..30: note = chr8:143199865-143199895
  misc_feature 1..30: note = Hypo
  source 1..30: mol_type = genomic DNA

SEQ ID NO: 130214 - DNA, 30 bp, Homo sapiens; identical to SEQ ID NO: 98890
  misc_feature 1..30: note = chr8:143200728-143200758
  misc_feature 1..30: note = Hypo
  source 1..30: mol_type = genomic DNA

SEQ ID NO: 130215 - DNA, 175 bp, Homo sapiens; identical to SEQ ID NO: 98891
  misc_feature 1..175: note = chr8:143210674-143210849
  misc_feature 1..175: note = Hypo
  source 1..175: mol_type = genomic DNA

SEQ ID NO: 130216 - DNA, 66 bp, Homo sapiens; identical to SEQ ID NO: 42012
  misc_feature 1..66: note = chr8:143217605-143217671
  misc_feature 1..66: note = Hypo
  source 1..66: mol_type = genomic DNA

SEQ ID NO: 130217 - DNA, 87 bp, Homo sapiens; identical to SEQ ID NO: 98893
  misc_feature 1..87: note = chr8:143223873-143223960
  misc_feature 1..87: note = Hypo
  source 1..87: mol_type = genomic DNA

SEQ ID NO: 130218 - DNA, 30 bp, Homo sapiens; identical to SEQ ID NO: 98894
  misc_feature 1..30: note = chr8:143237748-143237778
  misc_feature 1..30: note = Hypo
  source 1..30: mol_type = genomic DNA

SEQ ID NO: 130219 - DNA, 181 bp, Homo sapiens; identical to SEQ ID NO: 98895
  misc_feature 1..181: note = chr8:143246191-143246372
  misc_feature 1..181: note = Hypo
  source 1..181: mol_type = genomic DNA

SEQ ID NO: 130220 - DNA, 49 bp, Homo sapiens; identical to SEQ ID NO: 98896
  misc_feature 1..49: note = chr8:143251863-143251912
  misc_feature 1..49: note = Hypo
  source 1..49: mol_type = genomic DNA

SEQ ID NO: 130221 - DNA, 30 bp, Homo sapiens; identical to SEQ ID NO: 98897
  misc_feature 1..30: note = chr8:143258355-143258385
  misc_feature 1..30: note = Hypo
  source 1..30: mol_type = genomic DNA

SEQ ID NO: 130222 - DNA, 30 bp, Homo sapiens; identical to SEQ ID NO: 42013
  misc_feature 1..30: note = chr8:143265172-143265202
  misc_feature 1..30: note = Hypo
  source 1..30: mol_type = genomic DNA

SEQ ID NO: 130223 - DNA, 119 bp, Homo sapiens; identical to SEQ ID NO: 98899
  misc_feature 1..119: note = chr8:143314588-143314707
  misc_feature 1..119: note = Hypo
  source 1..119: mol_type = genomic DNA

SEQ ID NO: 130224 - DNA, 389 bp, Homo sapiens; identical to SEQ ID NO: 98900
  misc_feature 1..389: note = chr8:143317093-143317482
  misc_feature 1..389: note = Hypo
  source 1..389: mol_type = genomic DNA

SEQ ID NO: 130225 - DNA, 54 bp, Homo sapiens; identical to SEQ ID NO: 98901
  misc_feature 1..54: note = chr8:143319314-143319368
  misc_feature 1..54: note = Hypo
  source 1..54: mol_type = genomic DNA

SEQ ID NO: 130226 - DNA, 50 bp, Homo sapiens; identical to SEQ ID NO: 98902
  misc_feature 1..50: note = chr8:143326089-143326139
  misc_feature 1..50: note = Hypo
  source 1..50: mol_type = genomic DNA

SEQ ID NO: 130227 - DNA, 47 bp, Homo sapiens; identical to SEQ ID NO: 98903
  misc_feature 1..47: note = chr8:143329464-143329511
  misc_feature 1..47: note = Hypo
  source 1..47: mol_type = genomic DNA

SEQ ID NO: 130228 - DNA, 132 bp, Homo sapiens; identical to SEQ ID NO: 98904
  misc_feature 1..132: note = chr8:143332980-143333112
  misc_feature 1..132: note = Hypo
  source 1..132: mol_type = genomic DNA

SEQ ID NO: 130229 - DNA, 346 bp, Homo sapiens; identical to SEQ ID NO: 98905
  misc_feature 1..346: note = chr8:143333322-143333668
  misc_feature 1..346: note = Hypo
  source 1..346: mol_type = genomic DNA

SEQ ID NO: 130230 - DNA, 159 bp, Homo sapiens; identical to SEQ ID NO: 98906
  misc_feature 1..159: note = chr8:143334538-143334697
  misc_feature 1..159: note = Hypo
  source 1..159: mol_type = genomic DNA

SEQ ID NO: 130231 - DNA, 142 bp, Homo sapiens; identical to SEQ ID NO: 98907
  misc_feature 1..142: note = chr8:143386798-143386940
  misc_feature 1..142: note = Hypo
  source 1..142: mol_type = genomic DNA

SEQ ID NO: 130232 - DNA, 324 bp, Homo sapiens; identical to SEQ ID NO: 98908
  misc_feature 1..324: note = chr8:143405647-143405971
  misc_feature 1..324: note = Hypo
  source 1..324: mol_type = genomic DNA

SEQ ID NO: 130233 - DNA, 313 bp, Homo sapiens; identical to SEQ ID NO: 98909
  misc_feature 1..313: note = chr8:143436977-143437290
  misc_feature 1..313: note = Hypo
  source 1..313: mol_type = genomic DNA

SEQ ID NO: 130234 - DNA, 52 bp, Homo sapiens; identical to SEQ ID NO: 42023
  misc_feature 1..52: note = chr8:143463629-143463681
  misc_feature 1..52: note = Hypo
  source 1..52: mol_type = genomic DNA

SEQ ID NO: 130235 - DNA, 492 bp, Homo sapiens
  misc_feature 1..492: note = chr8:143509151-143509643
  misc_feature 1..492: note = Hypo
  source 1..492: mol_type = genomic DNA
gctgggattggagcccgccctgcctcggggaagatcctcgctccctttctccacggcacctctgtgattctcgtcacctgccaacaccagcaccagggctgcccctcctgacggccccctcgccgtctttctgggcacactccatcggcacagcgtcttcactgtcctcctgacaaacctcgtgccacccccatcagcttcagcaccacctccacagcagccgtggccagcaccgacgtccttttccgtcaccgtcaagcctcaaaactgggaccgtgggtaatggcgtcaccccatccgccgtctctctctagctgccaacggcgccttcaccagacacgcccggcaccaccttccaggtcagcagtcccagccctgcgtatcggaggcctgctctcccacagcgtccacagtcactgggccaggctcgcacctgtgaggggccaggacccataccggagcccggcgaggctccctcggccaccctctggg

SEQ ID NO: 130236 - DNA, 94 bp, Homo sapiens; identical to SEQ ID NO: 98913
  misc_feature 1..94: note = chr8:143511468-143511562
  misc_feature 1..94: note = Hypo
  source 1..94: mol_type = genomic DNA

SEQ ID NO: 130237 - DNA, 16 bp, Homo sapiens
  misc_feature 1..16: note = chr8:143518352-143518368
  misc_feature 1..16: note = Hypo
  source 1..16: mol_type = genomic DNA
gtagagttggagtcac

SEQ ID NO: 130238 - DNA, 1302 bp, Homo sapiens; identical to SEQ ID NO: 98915
  misc_feature 1..1302: note = chr8:143530469-143531771
  misc_feature 1..1302: note = Hyper
  source 1..1302: mol_type = genomic DNA

SEQ ID NO: 130239 - DNA, 2779 bp, Homo sapiens
  misc_feature 1..2779: note = chr8:143531978-143534757
  misc_feature 1..2779: note = Hyper
  source 1..2779: mol_type = genomic DNA
gacattgtaagggcccgagacgtcctccccccacgcacagagctcggggcaggcaggagaaaaccccagactccttctcgaagccctcgctcgtagaagccctcgcctgtagacctggcattggcagtggagactccctggaggtactctcccccacttcgggcggagggctatttttgcgccccccacccccacgcgaacgcctggctcttccctccttgtctacctttccactgggtcggacaggccgcgcggataagccgctctcaactttgggccggccctatgccgtctccgctccaagcgccgagcactcccgggcgccgagcactcccgggtccgcgtcgccggtgagcagaggccgccggccctccaccgtcgccgcgctagcttggagccgcgcggagctgcctcgaggaacgagcacggcccccgccccctcctggggaggctgggagctctggacccggccaggagccctctccctaggtccccgcggccccctgggcgaggtagagagctcctccggcctcgggagggggcggcggagctgagaatcaccgcgaagcgatgcgaccgggagggcttgacggaggctgcggctccgagcccgcgtccctcctcctggccgcggcggctcctgcttggccactccccggcagcctgaagagaacgcctaatctggcaccccagccccaggccgctgggcaccttacccctttccacttttattttgggcttctaagtttcttggagcgcaggcgcctaggctgggacccgaagagccctaagccagccctctttcagcacccgtccccgccgcgacctccccgttcttcctccgggtctggggcgcagattcctgggctgcaactccggagtagttgaaaggcaggaaggcgtgtgggcgggtagggggcctgcactcccgccccagaggagccgcttgtcgtttgtgttggggagggagctgggaggtctgctctcccgctccatcctgggaacccacggagaccctcggtactctccccacagacacaaacacacgccccctcggagcgagagccgccgcgggggaacagcagaggccgcgcgggcggaggcgggggaaaggggagctgggtcccttttctatctgggagggaggtggtatacggtgtgtggggtctggggaggcgactgtcacgtctcctagaaccctcatgccttccactcgtctgcgaccccggctgccgaggaggcaacgagggaggtcgagccgctccctcccgtgggcggcagcgaaactctgcgcccgcacgccggggtgccgccgagtccggctttgagtacccagcaaggtcaagcaggcgaaggagggggcgggggttcctgggcgcgcccccgtccgcgcacagtcggggccttggaagggggtgtgcgcagcccgccgagtcagtcccgctcgcctgccgcccgcgcccggtccccggaggcggacgttgcgcgcgttcggggatcccggagcgcccggcgccccacgccctcccttcggctcgctagctgctccttggcgctgctttcagacttgttgcgcctcgatctggggggcagaaggctggcccgggagacccggcggctgagggccgagccgcgaagcccagggatgcgccagagaggcgcgcggctccgcgggtgggcgctgcgctggggggctcgagcctggggtttgccgcctccgatcccagggacgggcgcttgttcctgccggggtcccgcgcaggggcggatagagggcgattcgtcgcctcggcctcaggcagcactcatccggatcccgggctagggagggggcgcagccaagttgtggagccctcggaggcccttccctctcccgcaggctccggcccctctcggacctcggtggccgcgtccgtgaaatggggacgcgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcggggcctggcatgaagggccccagggagggcctagcaagcgcccggggtccgagcagcctcctgcggcgtcctccgcccccggtcggcccgaccccgcctccgggagtgggtcgtggggcgcggagcccgtcctccggggacgccgcggggctccaggcccaggcggccggcgcggggccgcagtggcggaaggcggagggccggcgcgctgccgctgactgccgggagagggcgcccgcaccgcgcccgcgcggccctgcccgccccttccgtctcctccgcgcctggcccgcggctccggccccatcttgggcagccccggccgccacctccctcccgcccgcccgcccgcccgctcgctcgctcgctcgccgtccgctcccgccgccgggtcccgtgacgcgcctcgcgtctcggccggagcccccctcgccggcccggcccggtccccgtgtgcggtgcgctggcgtgagcgcgcgtttgcgtgctggtgtccatgtgtggcgcgcatgcacgtgcgtgcccgtccgggaggctgggggcacgtgtgtgcaggcatgcagacttgcacatgtgtgtgcgtgacgggggcgggtctcgcgccggtgtggccccggatggcaggatttagtcaaaccccgttttaccgtcggctctggctctgggctgcccccgggtctgctctgtgtgcacgggatggacccctg

SEQ ID NO: 130240 - DNA, 77 bp, Homo sapiens; identical to SEQ ID NO: 98920
  misc_feature 1..77: note = chr8:143535787-143535864
  misc_feature 1..77: note = Hypo
  source 1..77: mol_type = genomic DNA

SEQ ID NO: 130241 - DNA, 49 bp, Homo sapiens; identical to SEQ ID NO: 42027
  misc_feature 1..49: note = chr8:143538439-143538488
  misc_feature 1..49: note = Hypo
  source 1..49: mol_type = genomic DNA

SEQ ID NO: 130242 - DNA, 30 bp, Homo sapiens; identical to SEQ ID NO: 98922
  misc_feature 1..30: note = chr8:143539356-143539386
  misc_feature 1..30: note = Hypo
  source 1..30: mol_type = genomic DNA

SEQ ID NO: 130243 - DNA, 163 bp, Homo sapiens; identical to SEQ ID NO: 98923
  misc_feature 1..163: note = chr8:143543201-143543364
  misc_feature 1..163: note = Hypo
  source 1..163: mol_type = genomic DNA

SEQ ID NO: 130244 - DNA, 149 bp, Homo sapiens
  misc_feature 1..149: note = chr8:143545558-143545707
  misc_feature 1..149: note = Hyper
  source 1..149: mol_type = genomic DNA
gatgaggggccaggccgccgccccgggccccgtctggatcctcgccccgctgctactgctgctgctgctgctgggacgccgcgcgcgggcggccgccggagcagacgcggggcccgggcccgagccgtgcgccacgctggtgcagggaa

SEQ ID NO: 130245 - DNA, 47 bp, Homo sapiens
  misc_feature 1..47: note = chr8:143545916-143545963
  misc_feature 1..47: note = Hyper
  source 1..47: mol_type = genomic DNA
ttcgacgaggtgctgcggctctgcgacccctccgcacccctggcctt

SEQ ID NO: 130246 - DNA, 157 bp, Homo sapiens; identical to SEQ ID NO: 98924
  misc_feature 1..157: note = chr8:143550641-143550798
  misc_feature 1..157: note = Hypo
  source 1..157: mol_type = genomic DNA

SEQ ID NO: 130247 - DNA, 93 bp, Homo sapiens; identical to SEQ ID NO: 98925
  misc_feature 1..93: note = chr8:143555636-143555729
  misc_feature 1..93: note = Hypo
  source 1..93: mol_type = genomic DNA

SEQ ID NO: 130248 - DNA, 207 bp, Homo sapiens; identical to SEQ ID NO: 98926
  misc_feature 1..207: note = chr8:143556062-143556269
  misc_feature 1..207: note = Hypo
  source 1..207: mol_type = genomic DNA

SEQ ID NO: 130249 - DNA, 357 bp, Homo sapiens; identical to SEQ ID NO: 42029
  misc_feature 1..357: note = chr8:143557723-143558080
  misc_feature 1..357: note = Hypo
  source 1..357: mol_type = genomic DNA

SEQ ID NO: 130250 - DNA, 254 bp, Homo sapiens; identical to SEQ ID NO: 98928
  misc_feature 1..254: note = chr8:143558389-143558643
  misc_feature 1..254: note = Hypo
  source 1..254: mol_type = genomic DNA

SEQ ID NO: 130251 - DNA, 499 bp, Homo sapiens; identical to SEQ ID NO: 98929
  misc_feature 1..499: note = chr8:143560990-143561489
  misc_feature 1..499: note = Hypo
  source 1..499: mol_type = genomic DNA

SEQ ID NO: 130252 - DNA, 154 bp, Homo sapiens; identical to SEQ ID NO: 98930
  misc_feature 1..154: note = chr8:143567944-143568098
  misc_feature 1..154: note = Hypo
  source 1..154: mol_type = genomic DNA

SEQ ID NO: 130253 - DNA, 152 bp, Homo sapiens; identical to SEQ ID NO: 98931
  misc_feature 1..152: note = chr8:143572706-143572858
  misc_feature 1..152: note = Hypo
  source 1..152: mol_type = genomic DNA

SEQ ID NO: 130254 - DNA, 30 bp, Homo sapiens; identical to SEQ ID NO: 42033
  misc_feature 1..30: note = chr8:143573208-143573238
  misc_feature 1..30: note = Hypo
  source 1..30: mol_type = genomic DNA

SEQ ID NO: 130255 - DNA, 220 bp, Homo sapiens; identical to SEQ ID NO: 98933
  misc_feature 1..220: note = chr8:143587271-143587491
  misc_feature 1..220: note = Hypo
  source 1..220: mol_type = genomic DNA

SEQ ID NO: 130256 - DNA, 1264 bp, Homo sapiens
  misc_feature 1..1264: note = chr8:143591423-143592687
  misc_feature 1..1264: note = Hyper
  source 1..1264: mol_type = genomic DNA
aggaggaagaggaggcggaggaggaagaggaggaggtggaggaggaagaacaggaggaggaggttgggggtggagaggaggaggaggggtttgcagagcaggtcagtccctggtgcaccaagtaacaagtcctgtgcttaaatgcgtgctcagatgaaaagcggggcagtcgcggcccgtagacagcgggcggctgggtcagaccgcagagggaagtttccagcggcaagcctccccgcggggaaggctgtgtctgtcccaggagatgagccgcaggcaccaggggtgatgaggcccgggggaggtggatgtgggggatggagcggtcccaaggtcgtcagctccagccggcgccctgggccgcggggccggagagctccggagcggaccctcgccgcgctccgaacccgccccgcgcccccaggccacacccggctcgcaccctccccgctccacgtgcgcccacgcgcccctccgggcctccccctccttcccgcgcgggccgggggcgcgggccccggaggagctgggggcggcgggggcgcggggcgggcgactgccgggccccgggccagctctcgccccccgccccgcccccgatcgctcggctcccccgcccggcgctccctcgggctgcgctccgcggctctcggcggcggcggcggcgggcgcagagcgcggcatgggcgcccgggccgcggggcctggcggcggcgggcggacgggcgcgcggctgcgggcgcaggtgcggggcggcgggccggggccggggccggggcgcggagccgccgctcgggggccggggcgcccgcgtccccgccgccgctgacgctccgcctgtctccctcccgtgtcccgcccgcccccagaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcggtgagaccccggccgggccggcgggaggggcgccgggcaggggcgcgggcgggggctgccggcgggcctgcgggtggggagggcccgcacccgtcctgtcccggaggggtcgctgtggcccgcagccgccgtggcctggcccggccggcggggtccatgcgcctctggagagggtgggtgggcgccgagcgggtggcagtgtggagttggagacgggcctgggaggagtcgggacccccggaaagtggctgat

SEQ ID NO: 130257 - DNA, 306 bp, Homo sapiens; identical to SEQ ID NO: 98939
  misc_feature 1..306: note = chr8:143595515-143595821
  misc_feature 1..306: note = Hypo
  source 1..306: mol_type = genomic DNA

SEQ ID NO: 130258 - DNA, 171 bp, Homo sapiens; identical to SEQ ID NO: 98940
  misc_feature 1..171: note = chr8:143598967-143599138
  misc_feature 1..171: note = Hypo
  source 1..171: mol_type = genomic DNA

SEQ ID NO: 130259 - DNA, 30 bp, Homo sapiens; identical to SEQ ID NO: 42037
  misc_feature 1..30: note = chr8:143599572-143599602
  misc_feature 1..30: note = Hypo
  source 1..30: mol_type = genomic DNA

SEQ ID NO: 130260 - DNA, 30 bp, Homo sapiens; identical to SEQ ID NO: 98942
  misc_feature 1..30: note = chr8:143606129-143606159
  misc_feature 1..30: note = Hypo
  source 1..30: mol_type = genomic DNA

SEQ ID NO: 130261 - DNA, 35 bp, Homo sapiens; identical to SEQ ID NO: 98943
  misc_feature 1..35: note = chr8:143609580-143609615
  misc_feature 1..35: note = Hypo
  source 1..35: mol_type = genomic DNA

SEQ ID NO: 130262 - DNA, 67 bp, Homo sapiens; identical to SEQ ID NO: 98944
  misc_feature 1..67: note = chr8:143616161-143616228
  misc_feature 1..67: note = Hypo
  source 1..67: mol_type = genomic DNA

SEQ ID NO: 130263 - DNA, 47 bp, Homo sapiens; identical to SEQ ID NO: 42038
  misc_feature 1..47: note = chr8:143618365-143618412
  misc_feature 1..47: note = Hypo
  source 1..47: mol_type = genomic DNA

SEQ ID NO: 130264 - DNA, 88 bp, Homo sapiens; identical to SEQ ID NO: 98946
  misc_feature 1..88: note = chr8:143620736-143620824
  misc_feature 1..88: note = Hypo
  source 1..88: mol_type = genomic DNA

SEQ ID NO: 130265 - DNA, 161 bp, Homo sapiens; identical to SEQ ID NO: 15189
  misc_feature 1..161: note = chr8:143621956-143622117
  misc_feature 1..161: note = Hypo
  source 1..161: mol_type = genomic DNA

SEQ ID NO: 130266 - DNA, 541 bp, Homo sapiens; identical to SEQ ID NO: 98948
  misc_feature 1..541: note = chr8:143623394-143623935
  misc_feature 1..541: note = Hypo
  source 1..541: mol_type = genomic DNA

SEQ ID NO: 130267 - DNA, 30 bp, Homo sapiens; identical to SEQ ID NO: 42043
  misc_feature 1..30: note = chr8:143624997-143625027
  misc_feature 1..30: note = Hypo
  source 1..30: mol_type = genomic DNA

SEQ ID NO: 130268 - DNA, 34 bp, Homo sapiens; identical to SEQ ID NO: 42044
  misc_feature 1..34: note = chr8:143631480-143631514
  misc_feature 1..34: note = Hypo
  source 1..34: mol_type = genomic DNA

SEQ ID NO: 130269 - DNA, 45 bp, Homo sapiens; identical to SEQ ID NO: 98951
  misc_feature 1..45: note = chr8:143652467-143652512
  misc_feature 1..45: note = Hypo
  source 1..45: mol_type = genomic DNA

SEQ ID NO: 130270 - DNA, 95 bp, Homo sapiens; identical to SEQ ID NO: 98952
  misc_feature 1..95: note = chr8:143656193-143656288
  misc_feature 1..95: note = Hypo
  source 1..95: mol_type = genomic DNA

SEQ ID NO: 130271 - DNA, 37 bp, Homo sapiens; identical to SEQ ID NO: 98953
  misc_feature 1..37: note = chr8:143660632-143660669
  misc_feature 1..37: note = Hypo
  source 1..37: mol_type = genomic DNA

SEQ ID NO: 130272 - DNA, 40 bp, Homo sapiens; identical to SEQ ID NO: 98954
  misc_feature 1..40: note = chr8:143665380-143665420
  misc_feature 1..40: note = Hypo
  source 1..40: mol_type = genomic DNA

SEQ ID NO: 130273 - DNA, 33 bp, Homo sapiens; identical to SEQ ID NO: 98955
  misc_feature 1..33: note = chr8:143665824-143665857
  misc_feature 1..33: note = Hypo
  source 1..33: mol_type = genomic DNA

SEQ ID NO: 130274 - DNA, 30 bp, Homo sapiens; identical to SEQ ID NO: 98956
  misc_feature 1..30: note = chr8:143671868-143671898
  misc_feature 1..30: note = Hypo
  source 1..30: mol_type = genomic DNA

SEQ ID NO: 130275 - DNA, 30 bp, Homo sapiens; identical to SEQ ID NO: 98957
  misc_feature 1..30: note = chr8:143677149-143677179
  misc_feature 1..30: note = Hypo
  source 1..30: mol_type = genomic DNA

SEQ ID NO: 130276 - DNA, 30 bp, Homo sapiens; identical to SEQ ID NO: 98958
  misc_feature 1..30: note = chr8:143679642-143679672
  misc_feature 1..30: note = Hypo
  source 1..30: mol_type = genomic DNA

SEQ ID NO: 130277 - DNA, 353 bp, Homo sapiens; identical to SEQ ID NO: 98959
  misc_feature 1..353: note = chr8:143695463-143695816
  misc_feature 1..353: note = Hyper
  source 1..353: mol_type = genomic DNA

SEQ ID NO: 130278 - DNA, 30 bp, Homo sapiens; identical to SEQ ID NO: 42046
  misc_feature 1..30: note = chr8:143702052-143702082
  misc_feature 1..30: note = Hypo
  source 1..30: mol_type = genomic DNA

SEQ ID NO: 130279 - DNA, 30 bp, Homo sapiens; identical to SEQ ID NO: 98961
  misc_feature 1..30: note = chr8:143704046-143704076
  misc_feature 1..30: note = Hypo
  source 1..30: mol_type = genomic DNA

SEQ ID NO: 130280 - DNA, 30 bp, Homo sapiens; identical to SEQ ID NO: 98962
  misc_feature 1..30: note = chr8:143704780-143704810
  misc_feature 1..30: note = Hypo
  source 1..30: mol_type = genomic DNA

SEQ ID NO: 130281 - DNA, 136 bp, Homo sapiens; identical to SEQ ID NO: 98963
  misc_feature 1..136: note = chr8:143819384-143819520
  misc_feature 1..136: note = Hypo
  source 1..136: mol_type = genomic DNA

SEQ ID NO: 130282 - DNA, 30 bp, Homo sapiens; identical to SEQ ID NO: 42048
  misc_feature 1..30: note = chr8:143827179-143827209
  misc_feature 1..30: note = Hypo
  source 1..30: mol_type = genomic DNA

SEQ ID NO: 130283 - DNA, 45 bp, Homo sapiens; identical to SEQ ID NO: 98965
  misc_feature 1..45: note = chr8:143831792-143831837
  misc_feature 1..45: note = Hypo
  source 1..45: mol_type = genomic DNA

SEQ ID NO: 130284 - DNA, 61 bp, Homo sapiens; identical to SEQ ID NO: 42049
  misc_feature 1..61: note = chr8:143833212-143833273
  misc_feature 1..61: note = Hypo
  source 1..61: mol_type = genomic DNA

SEQ ID NO: 130285 - DNA, 30 bp, Homo sapiens; identical to SEQ ID NO: 98967
  misc_feature 1..30: note = chr8:143840647-143840677
  misc_feature 1..30: note = Hypo
  source 1..30: mol_type = genomic DNA

SEQ ID NO: 130286 - DNA, 30 bp, Homo sapiens; identical to SEQ ID NO: 98969
  misc_feature 1..30: note = chr8:143855362-143855392
  misc_feature 1..30: note = Hypo
  source 1..30: mol_type = genomic DNA

SEQ ID NO: 130287 - DNA, 159 bp, Homo sapiens; identical to SEQ ID NO: 98970
  misc_feature 1..159: note = chr8:143855667-143855826
  misc_feature 1..159: note = Hypo
  source 1..159: mol_type = genomic DNA

SEQ ID NO: 130288 - DNA, 30 bp, Homo sapiens; identical to SEQ ID NO: 98971
  misc_feature 1..30: note = chr8:143857179-143857209
  misc_feature 1..30: note = Hypo
  source 1..30: mol_type = genomic DNA

SEQ ID NO: 130289 - DNA, 217 bp, Homo sapiens; identical to SEQ ID NO: 98972
  misc_feature 1..217: note = chr8:143858535-143858752
  misc_feature 1..217: note = Hyper
  source 1..217: mol_type = genomic DNA

SEQ ID NO: 130290 - DNA, 234 bp, Homo sapiens
  misc_feature 1..234: note = chr8:143859127-143859361
  misc_feature 1..234: note = Hyper
  source 1..234: mol_type = genomic DNA
acacagaggcagccacgcagtgattccctggcgaccctcagactcacgtgttcagcccggacactccgcaggctatcttcaccgcgtcccgcggcagcccagccttccccgcagccgcctccgcccactcgcccgcgccgcgtcgtttgtcggccggcaccagccttgcggccccagctccgccctcctgcagcccaggcccagcagctccggaactggcgccctttggcgcac

SEQ ID NO: 130291 - DNA, 124 bp, Homo sapiens; identical to SEQ ID NO: 98975
  misc_feature 1..124: note = chr8:143870853-143870977
  misc_feature 1..124: note = Hypo
  source 1..124: mol_type = genomic DNA

SEQ ID NO: 130292 - DNA, 74 bp, Homo sapiens; identical to SEQ ID NO: 98976
  misc_feature 1..74: note = chr8:143876922-143876996
  misc_feature 1..74: note = Hypo
  source 1..74: mol_type = genomic DNA

SEQ ID NO: 130293 - DNA, 33 bp, Homo sapiens; identical to SEQ ID NO: 42052
  misc_feature 1..33: note = chr8:143879185-143879218
  misc_feature 1..33: note = Hypo
  source 1..33: mol_type = genomic DNA

SEQ ID NO: 130294 - DNA, 182 bp, Homo sapiens; identical to SEQ ID NO: 98978
  misc_feature 1..182: note = chr8:143882149-143882331
  misc_feature 1..182: note = Hypo
  source 1..182: mol_type = genomic DNA

SEQ ID NO: 130295 - DNA, 30 bp, Homo sapiens; identical to SEQ ID NO: 98979
  misc_feature 1..30: note = chr8:143921405-143921435
  misc_feature 1..30: note = Hypo
  source 1..30: mol_type = genomic DNA

SEQ ID NO: 130296 - DNA, 123 bp, Homo sapiens; identical to SEQ ID NO: 98980
  misc_feature 1..123: note = chr8:143956397-143956520
  misc_feature 1..123: note = Hypo
  source 1..123: mol_type = genomic DNA

SEQ ID NO: 130297 - DNA, 129 bp, Homo sapiens; identical to SEQ ID NO: 98981
  misc_feature 1..129: note = chr8:143956795-143956924
  misc_feature 1..129: note = Hypo
  source 1..129: mol_type = genomic DNA

SEQ ID NO: 130298 - DNA, 173 bp, Homo sapiens; identical to SEQ ID NO: 98982
  misc_feature 1..173: note = chr8:143960027-143960200
  misc_feature 1..173: note = Hypo
  source 1..173: mol_type = genomic DNA

SEQ ID NO: 130299 - DNA, 247 bp, Homo sapiens; identical to SEQ ID NO: 98983
  misc_feature 1..247: note = chr8:143993967-143994214
  misc_feature 1..247: note = Hypo
  source 1..247: mol_type = genomic DNA

SEQ ID NO: 130300 - DNA, 33 bp, Homo sapiens; identical to SEQ ID NO: 98984
  misc_feature 1..33: note = chr8:143994764-143994797
  misc_feature 1..33: note = Hypo
  source 1..33: mol_type = genomic DNA

SEQ ID NO: 130301 - DNA, 159 bp, Homo sapiens; identical to SEQ ID NO: 98985
  misc_feature 1..159: note = chr8:143996499-143996658
  misc_feature 1..159: note = Hypo
  source 1..159: mol_type = genomic DNA

SEQ ID NO: 130302 - DNA, 32 bp, Homo sapiens; identical to SEQ ID NO: 98986
  misc_feature 1..32: note = chr8:143998295-143998327
  misc_feature 1..32: note = Hypo
  source 1..32: mol_type = genomic DNA

SEQ ID NO: 130303 - DNA, 33 bp, Homo sapiens; identical to SEQ ID NO: 42057
  misc_feature 1..33: note = chr8:144015246-144015279
  misc_feature 1..33: note = Hypo
  source 1..33: mol_type = genomic DNA

SEQ ID NO: 130304 - DNA, 175 bp, Homo sapiens; identical to SEQ ID NO: 98988
  misc_feature 1..175: note = chr8:144027680-144027855
  misc_feature 1..175: note = Hypo
  source 1..175: mol_type = genomic DNA

SEQ ID NO: 130305 - DNA, 119 bp, Homo sapiens; identical to SEQ ID NO: 98989
  misc_feature 1..119: note = chr8:144058296-144058415
  misc_feature 1..119: note = Hypo
  source 1..119: mol_type = genomic DNA

SEQ ID NO: 130306 - DNA, 119 bp, Homo sapiens; identical to SEQ ID NO: 98990
  misc_feature 1..119: note = chr8:144069546-144069665
  misc_feature 1..119: note = Hypo
  source 1..119: mol_type = genomic DNA

SEQ ID NO: 130307 - DNA, 151 bp, Homo sapiens; identical to SEQ ID NO: 42060
  misc_feature 1..151: note = chr8:144070508-144070659
  misc_feature 1..151: note = Hypo
  source 1..151: mol_type = genomic DNA

SEQ ID NO: 130308 - DNA, 61 bp, Homo sapiens; identical to SEQ ID NO: 98992
  misc_feature 1..61: note = chr8:144090641-144090702
  misc_feature 1..61: note = Hypo
  source 1..61: mol_type = genomic DNA

SEQ ID NO: 130309 - DNA, 143 bp, Homo sapiens; identical to SEQ ID NO: 98993
  misc_feature 1..143: note = chr8:144099550-144099693
  misc_feature 1..143: note = Hyper
  source 1..143: mol_type = genomic DNA

SEQ ID NO: 130310 - DNA, 128 bp, Homo sapiens; identical to SEQ ID NO: 42062
  misc_feature 1..128: note = chr8:144164496-144164624
  misc_feature 1..128: note = Hypo
  source 1..128: mol_type = genomic DNA

SEQ ID NO: 130311 - DNA, 186 bp, Homo sapiens; identical to SEQ ID NO: 98995
  misc_feature 1..186: note = chr8:144190312-144190498
  misc_feature 1..186: note = Hypo
  source 1..186: mol_type = genomic DNA

SEQ ID NO: 130312 - DNA, 264 bp, Homo sapiens; identical to SEQ ID NO: 98996
  misc_feature 1..264: note = chr8:144203678-144203942
  misc_feature 1..264: note = Hypo
  source 1..264: mol_type = genomic DNA

SEQ ID NO: 130313 - DNA, 30 bp, Homo sapiens; identical to SEQ ID NO: 98997
  misc_feature 1..30: note = chr8:144204525-144204555
  misc_feature 1..30: note = Hypo
  source 1..30: mol_type = genomic DNA

SEQ ID NO: 130314 - DNA, 134 bp, Homo sapiens; identical to SEQ ID NO: 98998
  misc_feature 1..134: note = chr8:144208693-144208827
  misc_feature 1..134: note = Hypo
  source 1..134: mol_type = genomic DNA

SEQ ID NO: 130315 - DNA, 42 bp, Homo sapiens; identical to SEQ ID NO: 98999
  misc_feature 1..42: note = chr8:144209468-144209510
  misc_feature 1..42: note = Hypo
  source 1..42: mol_type = genomic DNA

SEQ ID NO: 130316 - DNA, 61 bp, Homo sapiens; identical to SEQ ID NO: 99000
  misc_feature 1..61: note = chr8:144216486-144216547
  misc_feature 1..61: note = Hypo
  source 1..61: mol_type = genomic DNA

SEQ ID NO: 130317 - DNA, 42 bp, Homo sapiens; identical to SEQ ID NO: 99001
  misc_feature 1..42: note = chr8:144222920-144222962
  misc_feature 1..42: note = Hypo
  source 1..42: mol_type = genomic DNA

SEQ ID NO: 130318 - DNA, 218 bp, Homo sapiens; identical to SEQ ID NO: 99002
  misc_feature 1..218: note = chr8:144226037-144226255
  misc_feature 1..218: note = Hypo
  source 1..218: mol_type = genomic DNA

SEQ ID NO: 130319 - DNA, 41 bp, Homo sapiens; identical to SEQ ID NO: 99003
  misc_feature 1..41: note = chr8:144236655-144236696
  misc_feature 1..41: note = Hypo
  source 1..41: mol_type = genomic DNA

SEQ ID NO: 130320 - DNA, 249 bp, Homo sapiens; identical to SEQ ID NO: 99004
  misc_feature 1..249: note = chr8:144238806-144239055
  misc_feature 1..249: note = Hypo
  source 1..249: mol_type = genomic DNA

SEQ ID NO: 130321 - DNA, 1104 bp, Homo sapiens
  misc_feature 1..1104: note = chr8:144241199-144242303
  misc_feature 1..1104: note = Hyper
  source 1..1104: mol_type = genomic DNA
cccggaatccaaggccggggtccgcccggagctcgcagagccccacccccagccccttctccagagcgtccgccgtcacagcatccccgccgggagacgtctggcctctggggcgaggtgacagctcgagacgcctccgccccgcgccggcacctgtgtgggggagcggatggggggcgtcctcttctccccggggagctgcaggtgcgtccggacaggaatgagcggcaggggcgggagcgggtgggacctgccactggggggaggggcgcgtgccaggtccccacccccacccctgggctggggggccgggaaccccgggccgagtcccctcccttggccttccgcgcgcgcctcggcgctcaccgcggatggggcgtggagcgcgggcctcggggtcggggggctcactcacatcccgggggtgtccgcactccgggctcgggcggcgtgcgcggcgcggggagctgtgcccttcggtctccctgcggaccggaatccgggcgcagcctcgtctttcggggaacgcagccgcagacgcggaccccgcgcgaggggcggggcggagccggggcgggggccgcgcggggggcgggggcggctgggagacgcgcggggcggggggcgcccggggctcgcggcccccacgcaggtagctggcccgggccctccgcgcccccttgctggcgcgcgcgctccctcgggttcccgctccctccctcgcggcgccccctgctcctccccagcctccgcggccccctacccaggcgtgggcaggatcccttccccctctgcttggctgagatccccttggaatttctcggaagaacgtttactgcgaaaggaagcaaaatgcacaaagacgcagagagggggaggtacccggcgcggcgccacgcgcaggtccgggttcgcagacccctggggtcagactcccgccctggggccccgccctccccctcctccccgcccctccccaacctcatacccgtttccccgtttccccgtttccagtggctccaggccgttctcctcccctgagcatccatgaagacccccaccagaagccgcagccccaggggcttctgtcgccaaatactccca

SEQ ID NO: 130322 - DNA, 30 bp, Homo sapiens; identical to SEQ ID NO: 99009
  misc_feature 1..30: note = chr8:144275059-144275089
  misc_feature 1..30: note = Hypo
  source 1..30: mol_type = genomic DNA

SEQ ID NO: 130323 - DNA, 104 bp, Homo sapiens; identical to SEQ ID NO: 99010
  misc_feature 1..104: note = chr8:144291486-144291590
  misc_feature 1..104: note = Hypo
  source 1..104: mol_type = genomic DNA

SEQ ID NO: 130324 - DNA, 125 bp, Homo sapiens; identical to SEQ ID NO: 99011
  misc_feature 1..125: note = chr8:144292345-144292470
  misc_feature 1..125: note = Hypo
  source 1..125: mol_type = genomic DNA

SEQ ID NO: 130325 - DNA, 317 bp, Homo sapiens; identical to SEQ ID NO: 99012
  misc_feature 1..317: note = chr8:144293576-144293893
  misc_feature 1..317: note = Hypo
  source 1..317: mol_type = genomic DNA

SEQ ID NO: 130326 - DNA, 39 bp, Homo sapiens; identical to SEQ ID NO: 99013
  misc_feature 1..39: note = chr8:144303553-144303592
  misc_feature 1..39: note = Hypo
  source 1..39: mol_type = genomic DNA

SEQ ID NO: 130327 - DNA, 147 bp, Homo sapiens; identical to SEQ ID NO: 42070
  misc_feature 1..147: note = chr8:144312859-144313006
  misc_feature 1..147: note = Hypo
  source 1..147: mol_type = genomic DNA

SEQ ID NO: 130328 - DNA, 30 bp, Homo sapiens; identical to SEQ ID NO: 99015
  misc_feature 1..30: note = chr8:144322593-144322623
  misc_feature 1..30: note = Hypo
  source 1..30: mol_type = genomic DNA

SEQ ID NO: 130329 - DNA, 214 bp, Homo sapiens; identical to SEQ ID NO: 42071
  misc_feature 1..214: note = chr8:144326825-144327039
  misc_feature 1..214: note = Hypo
  source 1..214: mol_type = genomic DNA

SEQ ID NO: 130330 - DNA, 434 bp, Homo sapiens; identical to SEQ ID NO: 99017
  misc_feature 1..434: note = chr8:144328173-144328607
  misc_feature 1..434: note = Hyper
  source 1..434: mol_type = genomic DNA

SEQ ID NO: 130331 - DNA, 149 bp, Homo sapiens; identical to SEQ ID NO: 42072
  misc_feature 1..149: note = chr8:144330269-144330418
  misc_feature 1..149: note = Hypo
  source 1..149: mol_type = genomic DNA

SEQ ID NO: 130332 - DNA, 511 bp, Homo sapiens; identical to SEQ ID NO: 42073
  misc_feature 1..511: note = chr8:144343481-144343992
  misc_feature 1..511: note = Hypo
  source 1..511: mol_type = genomic DNA

SEQ ID NO: 130333 - DNA, 519 bp, Homo sapiens; identical to SEQ ID NO: 99020
  misc_feature 1..519: note = chr8:144344219-144344738
  misc_feature 1..519: note = Hypo
  source 1..519: mol_type = genomic DNA

SEQ ID NO: 130334 - DNA, 37 bp, Homo sapiens; identical to SEQ ID NO: 99021
  misc_feature 1..37: note = chr8:144347022-144347059
  misc_feature 1..37: note = Hypo
  source 1..37: mol_type = genomic DNA

SEQ ID NO: 130335 - DNA, 30 bp, Homo sapiens; identical to SEQ ID NO: 99022
  misc_feature 1..30: note = chr8:144350950-144350980
  misc_feature 1..30: note = Hypo
  source 1..30: mol_type = genomic DNA

SEQ ID NO: 130336 - DNA, 516 bp, Homo sapiens; identical to SEQ ID NO: 99023
  misc_feature 1..516: note = chr8:144360029-144360545
  misc_feature 1..516: note = Hypo
  source 1..516: mol_type = genomic DNA

SEQ ID NO: 130337 - DNA, 203 bp, Homo sapiens; identical to SEQ ID NO: 99024
  misc_feature 1..203: note = chr8:144361658-144361861
  misc_feature 1..203: note = Hypo
  source 1..203: mol_type = genomic DNA

SEQ ID NO: 130338 - DNA, 15 bp, Homo sapiens
  misc_feature 1..15: note = chr8:144371132-144371147
  misc_feature 1..15: note = Hypo
  source 1..15: mol_type = genomic DNA
cggcctggactcggc

SEQ ID NO: 130339 - DNA, 40 bp, Homo sapiens; identical to SEQ ID NO: 99027
  misc_feature 1..40: note = chr8:144372463-144372503
  misc_feature 1..40: note = Hypo
  source 1..40: mol_type = genomic DNA

SEQ ID NO: 130340 - DNA, 30 bp, Homo sapiens; identical to SEQ ID NO: 99028
  misc_feature 1..30: note = chr8:144380615-144380645
  misc_feature 1..30: note = Hypo
  source 1..30: mol_type = genomic DNA

SEQ ID NO: 130341 - DNA, 92 bp, Homo sapiens; identical to SEQ ID NO: 99029
  misc_feature 1..92: note = chr8:144383315-144383407
  misc_feature 1..92: note = Hypo
  source 1..92: mol_type = genomic DNA

SEQ ID NO: 130342 - DNA, 35 bp, Homo sapiens; identical to SEQ ID NO: 42080
  misc_feature 1..35: note = chr8:144386583-144386618
  misc_feature 1..35: note = Hypo
  source 1..35: mol_type = genomic DNA

SEQ ID NO: 130343 - DNA, 30 bp, Homo sapiens; identical to SEQ ID NO: 99031
  misc_feature 1..30: note = chr8:144400398-144400428
  misc_feature 1..30: note = Hypo
  source 1..30: mol_type = genomic DNA

SEQ ID NO: 130344 - DNA, 30 bp, Homo sapiens; identical to SEQ ID NO: 99032
  misc_feature 1..30: note = chr8:144413752-144413782
  misc_feature 1..30: note = Hypo
  source 1..30: mol_type = genomic DNA

SEQ ID NO: 130345 - DNA, 35 bp, Homo sapiens; identical to SEQ ID NO: 99033
  misc_feature 1..35: note = chr8:144414248-144414283
  misc_feature 1..35: note = Hypo
  source 1..35: mol_type = genomic DNA

SEQ ID NO: 130346 - DNA, 30 bp, Homo sapiens; identical to SEQ ID NO: 42081
  misc_feature 1..30: note = chr8:144452062-144452092
  misc_feature 1..30: note = Hypo
  source 1..30: mol_type = genomic DNA

SEQ ID NO: 130347 - DNA, 99 bp, Homo sapiens; identical to SEQ ID NO: 99035
  misc_feature 1..99: note = chr8:144457736-144457835
  misc_feature 1..99: note = Hypo
  source 1..99: mol_type = genomic DNA

SEQ ID NO: 130348 - DNA, 30 bp, Homo sapiens; identical to SEQ ID NO: 99036
  misc_feature 1..30: note = chr8:144462244-144462274
  misc_feature 1..30: note = Hypo
  source 1..30: mol_type = genomic DNA

SEQ ID NO: 130349 - DNA, 30 bp, Homo sapiens; identical to SEQ ID NO: 99037
  misc_feature 1..30: note = chr8:144463829-144463859
  misc_feature 1..30: note = Hypo
  source 1..30: mol_type = genomic DNA

SEQ ID NO: 130350 - DNA, 30 bp, Homo sapiens; identical to SEQ ID NO: 99038
  misc_feature 1..30: note = chr8:144469769-144469799
  misc_feature 1..30: note = Hypo
  source 1..30: mol_type = genomic DNA

SEQ ID NO: 130351 - DNA, 30 bp, Homo sapiens; identical to SEQ ID NO: 99039
  misc_feature 1..30: note = chr8:144470566-144470596
  misc_feature 1..30: note = Hypo
  source 1..30: mol_type = genomic DNA

SEQ ID NO: 130352 - DNA, 210 bp, Homo sapiens; identical to SEQ ID NO: 99040
  misc_feature 1..210: note = chr8:144471625-144471835
  misc_feature 1..210: note = Hypo
  source 1..210: mol_type = genomic DNA

SEQ ID NO: 130353 - DNA, 30 bp, Homo sapiens; identical to SEQ ID NO: 99041
  misc_feature 1..30: note = chr8:144474879-144474909
  misc_feature 1..30: note = Hypo
  source 1..30: mol_type = genomic DNA

SEQ ID NO: 130354 - DNA, 502 bp, Homo sapiens; identical to SEQ ID NO: 99042
  misc_feature 1..502: note = chr8:144489693-144490195
  misc_feature 1..502: note = Hyper
  source 1..502: mol_type = genomic DNA

SEQ ID NO: 130355 - DNA, 346 bp, Homo sapiens; identical to SEQ ID NO: 99043
  misc_feature 1..346: note = chr8:144503380-144503726
  misc_feature 1..346: note = Hyper
  source 1..346: mol_type = genomic DNA

SEQ ID NO: 130356 - DNA, 30 bp, Homo sapiens; identical to SEQ ID NO: 99044
  misc_feature 1..30: note = chr8:144508721-144508751
  misc_feature 1..30: note = Hyper
  source 1..30: mol_type = genomic DNA

SEQ ID NO: 130357 - DNA, 3353 bp, Homo sapiens; identical to SEQ ID NO: 99045
  misc_feature 1..3353: note = chr8:144509019-144512372
  misc_feature 1..3353: note = Hyper
  source 1..3353: mol_type = genomic DNA

SEQ ID NO: 130358 - DNA, 30 bp, Homo sapiens; identical to SEQ ID NO: 99046
  misc_feature 1..30: note = chr8:144516420-144516450
  misc_feature 1..30: note = Hypo
  source 1..30: mol_type = genomic DNA

SEQ ID NO: 130359 - DNA, 30 bp, Homo sapiens; identical to SEQ ID NO: 99047
  misc_feature 1..30: note = chr8:144519943-144519973
  misc_feature 1..30: note = Hypo
  source 1..30: mol_type = genomic DNA

SEQ ID NO: 130360 - DNA, 142 bp, Homo sapiens; identical to SEQ ID NO: 99048
  misc_feature 1..142: note = chr8:144521622-144521764
  misc_feature 1..142: note = Hypo
  source 1..142: mol_type = genomic DNA

SEQ ID NO: 130361 - DNA, 30 bp, Homo sapiens; identical to SEQ ID NO: 99049
  misc_feature 1..30: note = chr8:144523644-144523674
  misc_feature 1..30: note = Hypo
  source 1..30: mol_type = genomic DNA

SEQ ID NO: 130362 - DNA, 77 bp, Homo sapiens; identical to SEQ ID NO: 99050
  misc_feature 1..77: note = chr8:144552565-144552642
  misc_feature 1..77: note = Hypo
  source 1..77: mol_type = genomic DNA

SEQ ID NO: 130363 - DNA, 241 bp, Homo sapiens; identical to SEQ ID NO: 99051
  misc_feature 1..241: note = chr8:144573164-144573405
  misc_feature 1..241: note = Hypo
  source 1..241: mol_type = genomic DNA

SEQ ID NO: 130364 - DNA, 105 bp, Homo sapiens; identical to SEQ ID NO: 99052
  misc_feature 1..105: note = chr8:144589977-144590082
  misc_feature 1..105: note = Hypo
  source 1..105: mol_type = genomic DNA

SEQ ID NO: 130365 - DNA, 98 bp, Homo sapiens; identical to SEQ ID NO: 99053
  misc_feature 1..98: note = chr8:144591105-144591203
  misc_feature 1..98: note = Hypo
  source 1..98: mol_type = genomic DNA

SEQ ID NO: 130366 - DNA, 137 bp, Homo sapiens; identical to SEQ ID NO: 99054
  misc_feature 1..137: note = chr8:144636432-144636569
  misc_feature 1..137: note = Hypo
  source 1..137: mol_type = genomic DNA

SEQ ID NO: 130367 - DNA, 197 bp, Homo sapiens; identical to SEQ ID NO: 99055
  misc_feature 1..197: note = chr8:144636689-144636886
  misc_feature 1..197: note = Hypo
  source 1..197: mol_type = genomic DNA

SEQ ID NO: 130368 - DNA, 261 bp, Homo sapiens; identical to SEQ ID NO: 99056
  misc_feature 1..261: note = chr8:144650869-144651130
  misc_feature 1..261: note = Hyper
  source 1..261: mol_type = genomic DNA

SEQ ID NO: 130369 - DNA, 405 bp, Homo sapiens
  misc_feature 1..405: note = chr8:144651594-144651999
  misc_feature 1..405: note = Hyper
  source 1..405: mol_type = genomic DNA
cggggcgtttgctcacgtcgtccagtagcggagggaggcgcggtcccagctccgcgctcaggagccgcacaggcgcccggggccgcagcaggagcctcctcagggcgcccagcgctgcacccacgagccgcgcgtcgccttcgcccagtgcgcccaggagcgccggcagcagcgtgctcacgtgccgcacctgctgggactcggggtcagcctcttgcagacctcgccgcgaccgggccaagcccctctccacccctccccttctctcacaccttcctgcgattcagcgcgaggtggcccaggcccagcaggcccaaccagcgcacagtgggttcggggtctccctgccaggtgaggagtcgctccaggatgacctcctcccgcaggagccgtgcggtgggccgg

SEQ ID NO: 130370 - DNA, 199 bp, Homo sapiens; identical to SEQ ID NO: 99059
  misc_feature 1..199: note = chr8:144653759-144653958
  misc_feature 1..199: note = Hyper
  source 1..199: mol_type = genomic DNA

SEQ ID NO: 130371 - DNA, 175 bp, Homo sapiens; identical to SEQ ID NO: 42087
  misc_feature 1..175: note = chr8:144656770-144656945
  misc_feature 1..175: note = Hypo
  source 1..175: mol_type = genomic DNA

SEQ ID NO: 130372 - DNA, 83 bp, Homo sapiens; identical to SEQ ID NO: 99061
  misc_feature 1..83: note = chr8:144658208-144658291
  misc_feature 1..83: note = Hypo
  source 1..83: mol_type = genomic DNA

SEQ ID NO: 130373 - DNA, 30 bp, Homo sapiens; identical to SEQ ID NO: 99062
  misc_feature 1..30: note = chr8:144661901-144661931
  misc_feature 1..30: note = Hypo
  source 1..30: mol_type = genomic DNA

SEQ ID NO: 130374 - DNA, 378 bp, Homo sapiens; identical to SEQ ID NO: 99063
  misc_feature 1..378: note = chr8:144668612-144668990
  misc_feature 1..378: note = Hypo
  source 1..378: mol_type = genomic DNA

SEQ ID NO: 130375 - DNA, 119 bp, Homo sapiens; identical to SEQ ID NO: 99064
  misc_feature 1..119: note = chr8:144675999-144676118
  misc_feature 1..119: note = Hypo
  source 1..119: mol_type = genomic DNA

SEQ ID NO: 130376 - DNA, 191 bp, Homo sapiens; identical to SEQ ID NO: 99065
  misc_feature 1..191: note = chr8:144677837-144678028
  misc_feature 1..191: note = Hypo
  source 1..191: mol_type = genomic DNA

SEQ ID NO: 130377 - DNA, 231 bp, Homo sapiens; identical to SEQ ID NO: 99066
  misc_feature 1..231: note = chr8:144681590-144681821
  misc_feature 1..231: note = Hypo
  source 1..231: mol_type = genomic DNA

SEQ ID NO: 130378 - DNA, 30 bp, Homo sapiens; identical to SEQ ID NO: 99067
  misc_feature 1..30: note = chr8:144682361-144682391
  misc_feature 1..30: note = Hypo
  source 1..30: mol_type = genomic DNA

SEQ ID NO: 130379 - DNA, 126 bp, Homo sapiens; identical to SEQ ID NO: 99068
  misc_feature 1..126: note = chr8:144683678-144683804
  misc_feature 1..126: note = Hypo
  source 1..126: mol_type = genomic DNA

SEQ ID NO: 130380 - DNA, 122 bp, Homo sapiens; identical to SEQ ID NO: 42092
  misc_feature 1..122: note = chr8:144685577-144685699
  misc_feature 1..122: note = Hypo
  source 1..122: mol_type = genomic DNA

SEQ ID NO: 130381 - DNA, 30 bp, Homo sapiens; identical to SEQ ID NO: 99070
  misc_feature 1..30: note = chr8:144688031-144688061
  misc_feature 1..30: note = Hypo
  source 1..30: mol_type = genomic DNA

SEQ ID NO: 130382 - DNA, 80 bp, Homo sapiens; identical to SEQ ID NO: 99071
  misc_feature 1..80: note = chr8:145236678-145236758
  misc_feature 1..80: note = Hypo
  source 1..80: mol_type = genomic DNA

SEQ ID NO: 130383 - DNA, 30 bp, Homo sapiens; identical to SEQ ID NO: 99072
  misc_feature 1..30: note = chr8:145697556-145697586
  misc_feature 1..30: note = Hypo
  source 1..30: mol_type = genomic DNA

SEQ ID NO: 130384 - DNA, 641 bp, Homo sapiens
  misc_feature 1..641: note = chr8:145697791-145698432
  misc_feature 1..641: note = Hyper
  source 1..641: mol_type = genomic DNA
cccagaaggccagggcgggatccaggtggctggcctcacccactgggacgtgcccaacctggagacattgcaccaggtagggctgcaccgctctccgagaccccgccccgtgcttccacttgggggcggggaccctgcacctgaccagcccttcgccccgccttccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggtaccacggccggtgcctgagccctgcggagtctccagagcacccgaggcccggccttcccccatgtcgggctcgctcgcccctctaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgc

SEQ ID NO: 130385 - DNA, 30 bp, Homo sapiens
  misc_feature 1..30: note = chr8:145698644-145698674
  misc_feature 1..30: note = Hyper
  source 1..30: mol_type = genomic DNA
tcagcaccgacactccgctcaccgggaccc

SEQ ID NO: 130386 - DNA, 578 bp, Homo sapiens; identical to SEQ ID NO: 99075
  misc_feature 1..578: note = chr8:145700223-145700801
  misc_feature 1..578: note = Hyper
  source 1..578: mol_type = genomic DNA

SEQ ID NO: 130387 - DNA, 30 bp, Homo sapiens; identical to SEQ ID NO: 99076
  misc_feature 1..30: note = chr8:145702531-145702561
  misc_feature 1..30: note = Hypo
  source 1..30: mol_type = genomic DNA

SEQ ID NO: 130388 - DNA, 168 bp, Homo sapiens; identical to SEQ ID NO: 99077
  misc_feature 1..168: note = chr8:145728372-145728540
  misc_feature 1..168: note = Hypo
  source 1..168: mol_type = genomic DNA

SEQ ID NO: 130389 - DNA, 185 bp, Homo sapiens; identical to SEQ ID NO: 42093
  misc_feature 1..185: note = chr8:145739768-145739953
  misc_feature 1..185: note = Hypo
  source 1..185: mol_type = genomic DNA

SEQ ID NO: 130390 - DNA, 86 bp, Homo sapiens; identical to SEQ ID NO: 99079
  misc_feature 1..86: note = chr8:145745121-145745207
  misc_feature 1..86: note = Hypo
  source 1..86: mol_type = genomic DNA

SEQ ID NO: 130391 - DNA, 30 bp, Homo sapiens; identical to SEQ ID NO: 99080
  misc_feature 1..30: note = chr8:145751684-145751714
  misc_feature 1..30: note = Hypo
  source 1..30: mol_type = genomic DNA

SEQ ID NO: 130392 - DNA, 30 bp, Homo sapiens; identical to SEQ ID NO: 99081
  misc_feature 1..30: note = chr8:145751965-145751995
  misc_feature 1..30: note = Hypo
  source 1..30: mol_type = genomic DNA

SEQ ID NO: 130393 - DNA, 521 bp, Homo sapiens; identical to SEQ ID NO: 99082
  misc_feature 1..521: note = chr8:145753251-145753772
  misc_feature 1..521: note = Hypo
  source 1..521: mol_type = genomic DNA

SEQ ID NO: 130394 - DNA, 30 bp, Homo sapiens; identical to SEQ ID NO: 99083
  misc_feature 1..30: note = chr8:145755230-145755260
  misc_feature 1..30: note = Hyper
  source 1..30: mol_type = genomic DNA

SEQ ID NO: 130395 - DNA, 166 bp, Homo sapiens; identical to SEQ ID NO: 99084
  misc_feature 1..166: note = chr8:145758526-145758692
  misc_feature 1..166: note = Hypo
  source 1..166: mol_type = genomic DNA

SEQ ID NO: 130396 - DNA, 87 bp, Homo sapiens
  misc_feature 1..87: note = chr8:145806186-145806273
  misc_feature 1..87: note = Hyper
  source 1..87: mol_type = genomic DNA
ccattcacctggccccgcccatagcagctgcccccgccctcacctgccgctgtcctccttcactgtcccaaacgccgcgggccgccc

SEQ ID NO: 130397 - DNA, 30 bp, Homo sapiens
  misc_feature 1..30: note = chr8:145806596-145806626
  misc_feature 1..30: note = Hyper
  source 1..30: mol_type = genomic DNA
cggtgaccaggttggcgtacatgcgctcgc

SEQ ID NO: 130398 - DNA, 18 bp, Homo sapiens
  misc_feature 1..18: note = chr8:145919061-145919079
  misc_feature 1..18: note = Hypo
  source 1..18: mol_type = genomic DNA
ggccgtaaaattctttga

SEQ ID NO: 130399 - DNA, 424 bp, Homo sapiens
  misc_feature 1..424: note = chr8:145925298-145925722
  misc_feature 1..424: note = Hyper
  source 1..424: mol_type = genomic DNA
acagaactctttctccgtgaatcgcatccttttctgtgcgggatgatttacattctgggaacaaacggggccgtatctcacagtgctgcaggatgccagtggtgcaaacagtcggcgacccggccatttcccgagggtctcaggcgtcccacccaacggccgctccccgttccctgtccgtcacctcctcgttctcctacgaaggcgcgaacgttccagactctcgccggtcctcgacagcactcattcagtctcccccctggagatcccaggctgtactctgggacagaaaagaaggcgggtacgaccgcggtgtcgggtcctaccttagccgctccttctcctgagggagccaggcgggagagaggggaaccaccgaggcctcggtcttcccgcgtcccagagcggccgggcgagtctcact

SEQ ID NO: 130400 - DNA, 43 bp, Homo sapiens; identical to SEQ ID NO: 99090
  misc_feature 1..43: note = chr8:145925938-145925981
  misc_feature 1..43: note = Hyper
  source 1..43: mol_type = genomic DNA

SEQ ID NO: 130401 - DNA, 36 bp, Homo sapiens
  misc_feature 1..36: note = chr8:145938903-145938939
  misc_feature 1..36: note = Hyper
  source 1..36: mol_type = genomic DNA
cgtggggaggggccacgtccccgctgccccagccag

SEQ ID NO: 130402 - DNA, 192 bp, Homo sapiens; identical to SEQ ID NO: 42098
  misc_feature 1..192: note = chr8:145979452-145979644
  misc_feature 1..192: note = Hypo
  source 1..192: mol_type = genomic DNA

SEQ ID NO: 130403 - DNA, 136 bp, Homo sapiens; identical to SEQ ID NO: 99092
  misc_feature 1..136: note = chr8:146013511-146013647
  misc_feature 1..136: note = Hypo
  source 1..136: mol_type = genomic DNA

SEQ ID NO: 130404 - DNA, 30 bp, Homo sapiens; identical to SEQ ID NO: 99093
  misc_feature 1..30: note = chr8:146015447-146015477
  misc_feature 1..30: note = Hypo
  source 1..30: mol_type = genomic DNA

SEQ ID NO: 130405 - DNA, 34 bp, Homo sapiens; identical to SEQ ID NO: 99094
  misc_feature 1..34: note = chr8:146036285-146036319
  misc_feature 1..34: note = Hypo
  source 1..34: mol_type = genomic DNA

SEQ ID NO: 130406 - DNA, 30 bp, Homo sapiens; identical to SEQ ID NO: 42100
  misc_feature 1..30: note = chr8:146050247-146050277
  misc_feature 1..30: note = Hypo
  source 1..30: mol_type = genomic DNA

SEQ ID NO: 130407 - DNA, 34 bp, Homo sapiens; identical to SEQ ID NO: 99096
  misc_feature 1..34: note = chr8:146055565-146055599
  misc_feature 1..34: note = Hypo
  source 1..34: mol_type = genomic DNA

SEQ ID NO: 130408 - DNA, 98 bp, Homo sapiens; identical to SEQ ID NO: 5087
  misc_feature 1..98: note = chr8:146079215-146079313
  misc_feature 1..98: note = Hypo
  source 1..98: mol_type = genomic DNA

SEQ ID NO: 130409 - DNA, 278 bp, Homo sapiens; identical to SEQ ID NO: 101179
  misc_feature 1..278: note = chr9:73219-73497
  misc_feature 1..278: note = Hyper
  source 1..278: mol_type = genomic DNA

SEQ ID NO: 130410 - DNA, 935 bp, Homo sapiens
  misc_feature 1..935: note = chr9:113392-114327
  misc_feature 1..935: note = Hyper
  source 1..935: mol_type = genomic DNA
cgccccttggaccttcgccccaggccggcgcagcccagcttcccgggcaggctccacgctaccggggtccagtgcgcggcgacgaagcggagagctgtgtccagactccggagagaaactccggctccgcggggcggcgcggggcggcgcggggcccggagctgcccaactccgccgcctcgggaaggcggcttcgggcccgcagggagccccggggagggttcccggttccgccggcagcggcgtcgaggggtgcctgggctcctggggaccgcgagaggaaaaagaacggaaatcgcaccggggaggaaggacgcgcagaacgcccccgtgaagcggggtgctccggtcaggcgtgcgcgggagcgcggtccgggggagtccggcggcgccgtcgcgcgcactcggcagaggcttcgcgggagaacgcgcagcccggggcgtggggcggggaactgcccgcgcgaggctttcggcgcgtctgggtctcggcgagagcaaagcgcgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctggaaaacggagacttccgtagcgtcttcttcagtgcgtgctgcgagtgctgaaggaggacccggtgcctggacgacccggagcaggggaagcactcggccgacgctgtcgctgtcatcggcgtcattggcgggcaggacagtggggcgggtaaggggcctccccgcgcctcccggcccttcgcgctcggcgccagctctttggctcccttccctgcgcagctctaggctt

SEQ ID NO: 130411 - DNA, 213 bp, Homo sapiens; identical to SEQ ID NO: 100186
  misc_feature 1..213: note = chr9:114717-114930
  misc_feature 1..213: note = Hyper
  source 1..213: mol_type = genomic DNA

SEQ ID NO: 130412 - DNA, 264 bp, Homo sapiens
  misc_feature 1..264: note = chr9:117872-118136
  misc_feature 1..264: note = Hyper
  source 1..264: mol_type = genomic DNA
caaactctgaggggtcgctcgggccgccgccgccctcgatgtgctctcggggaagcgcaaccccgccccaccgggccacctgcagccccggctggagcgactgctctaggaactgctggctcgccgcctcctcctcgtcttcatcttcctcctctcccaggacatcgattttaccgtcttccccatcggagtcccggaggctgcgctgcggtgtggagcgaaggcgctcagctcttggcaagttcatggcggagcaggtgcttc

SEQ ID NO: 130413 - DNA, 697 bp, Homo sapiens; identical to SEQ ID NO: 100975
  misc_feature 1..697: note = chr9:214651-215348
  misc_feature 1..697: note = Hyper
  source 1..697: mol_type = genomic DNA

SEQ ID NO: 130414 - DNA, 24 bp, Homo sapiens
  misc_feature 1..24: note = chr9:258867-258891
  misc_feature 1..24: note = Hypo
  source 1..24: mol_type = genomic DNA
gattacgggcgtgagccaccatat

SEQ ID NO: 130415 - DNA, 101 bp, Homo sapiens; identical to SEQ ID NO: 101024
  misc_feature 1..101: note = chr9:284463-284564
  misc_feature 1..101: note = Hypo
  source 1..101: mol_type = genomic DNA

SEQ ID NO: 130416 - DNA, 30 bp, Homo sapiens; identical to SEQ ID NO: 101085
  misc_feature 1..30: note = chr9:360368-360398
  misc_feature 1..30: note = Hypo
  source 1..30: mol_type = genomic DNA

SEQ ID NO: 130417 - DNA, 30 bp, Homo sapiens; identical to SEQ ID NO: 101119
  misc_feature 1..30: note = chr9:377164-377194
  misc_feature 1..30: note = Hypo
  source 1..30: mol_type = genomic DNA

SEQ ID NO: 130418 - DNA, 30 bp, Homo sapiens; identical to SEQ ID NO: 101133
  misc_feature 1..30: note = chr9:415015-415045
  misc_feature 1..30: note = Hypo
  source 1..30: mol_type = genomic DNA

SEQ ID NO: 130419 - DNA, 35 bp, Homo sapiens; identical to SEQ ID NO: 101140
  misc_feature 1..35: note = chr9:505604-505639
  misc_feature 1..35: note = Hyper
  source 1..35: mol_type = genomic DNA

SEQ ID NO: 130420 - DNA, 30 bp, Homo sapiens; identical to SEQ ID NO: 101143
  misc_feature 1..30: note = chr9:592406-592436
  misc_feature 1..30: note = Hypo
  source 1..30: mol_type = genomic DNA

SEQ ID NO: 130421 - DNA, 877 bp, Homo sapiens
  misc_feature 1..877: note = chr9:841367-842244
  misc_feature 1..877: note = Hyper
  source 1..877: mol_type = genomic DNA
gcttcctcggtgcaccgtgctttggcaaccgggtcttggcgcctccgagagcggggcgaggggtgccacgcgattcccaggccgctctgtatctctcggtgcgcttgcagggaccctgcagcaaagccctggatgcttgcagccggtgcaagtttgcaagcagctggagagcggtggctggagtcggggggcggtgggcgtggccacgctccctcccaggcagtcccgggaatgttctgaaaagtatccgaaagttctgagtcgcgcgcgcgccaaaagaaaaggcacaaccccccaccactccgggcgtggcgtgcccagacctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtgggtgcgggcgtgcgggagcccgggttcagccttagtttttttttttttt

SEQ ID NO: 130422 - DNA, 1176 bp, Homo sapiens
  misc_feature 1..1176: note = chr9:842544-843720
  misc_feature 1..1176: note = Hyper
  source 1..1176: mol_type = genomic DNA
tttcttgaatgaagtccccccagcatggccgttgccatgcgggtcctgggttgtggagagatgcggcggtacttgccgacagcggcggcgcttggggtcctgggctcccggccacgctacatcgccggtctgggagcgccggagacgcgtctgatcccgcccgccgggcagagttgcgggcttcgctcggctcggggttccccacgatctctcaccctgtgtttcggcggagttgcgggggttccctctgctcccgggtccctgagatccctgatcccgctctcagggcagggaattccggggttcgcccctctgggcttccccgcgatcccagagcccgcgttccaacagaattgggagggtttattgcgctagaggagtcttcaggatcttcgctcccgccctccgaggtgaggctagaggggagggttcgactccaagggaatcccagggatctctagccccgctcttctagcagagaattaaggaattctctccgctttggggtcccaaaaatctccgaccgcgccttgggagcagagggtttcggggttcgatttcctcgagcgtccccagaatctctgactctccctccttgctgagttgcacttaaattagaaaggatcttggagggcggcagcgctggctgctaggttagcgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcgcctcagccattttgagagctctggaaattttattagcattttaaaatttgcattctcgaccgaagattaaagtgcaaattactttgaagatgttttaaagcacgcttaagaattttaaagaatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgc

SEQ ID NO: 130423 - DNA, 1638 bp, Homo sapiens
  misc_feature 1..1638: note = chr9:969556-971194
  misc_feature 1..1638: note = Hyper
  source 1..1638: mol_type = genomic DNA
ctgtagctgttgtgacggctacggcggaggctgcggccgcgcggggaatggagccggaccgcggagtcgtcacctccaaggtgtttctagtggcctcctggaagatgatcccgcgcccaccttgccggcgtgttcgcgggcccctgcccactgccccccctctttctttaggtctggcttttgaggatcccggagtcttgcagctcccgccattccgcagataacctccgcacacttaattgtgacccgcggggtggtcggagaagctccgcacgcgtcctcagtgggaaagtgtcccctctcagcactgcccccttcagtccccctgcatttctggaaagtcaggcaaggcccaggtaggctgccagtgcactctcagccttgactgagcacctttcgggcctctggtgagccccgagagccaggtttggctcggcagagcgggcttgggctgcgcaagcaatgcgcatcgtggccgcctgcaccctgggaactaggcctgtccagtgggcagcatcctcatttttgaaaaggcccttctaaacccaccggcctcgcctaacgccgtttggtgctgcatccgagcggcctcacgcggtcccctggaagggccactcccagcgggagggcggggcccgggacctgcgctggccacgcagggtctcaagctgaccggaagacccggcttttggcctgtgtccaatagccccagaagagaggggtctggagccttcctcccacgcgtagtgacgctcaggtgtcctcgggttgttagtcttgacccaggagagtgcaagacaggcccaaggcctggggggattgcgttatgaatgtccaattctaaacacaaggtagagcacagacagtacatcctcacggctggattttaaccgtattttaataaacacattcgagggggtgtcagtttccccaagctctgcccccttccgcgggcgggatccatggtgtgtgcagtgtaagagtgcgcagaacgcgtgtgttcaagtgtgggcgtggcaggcgtcgtgtgctcgccccgcgcactgtgcggatcgcccagacagccttgacaggtttttgcagatgtttgggtgctacggtgtggggaaacccaggcaggagcgccaggcctaattctcctggactcttggtgagcggccgctactccacgaggggctagaagcaaagggggcacgcgcttttccccaggccgcctcttgctgccgcagtggctgagggcgctgatgacccctccccgcttccagcggacttgacccgcgggctgacaacccaccgcgacaagcaggcggctgggttcgcgccgccgccccggggcccttggctcaaatttcacctcgagtcctgcagaccctgcgccactgaattggggcccaggacgcccttggtgacactcgccttcttgctgccacaaccaccgtcatacccgcagccggggctccctccgctaaccacgcttggagaccccaatcggggacagaggtgggagtcagaccccccctggcctgcactgccgtttccctcgattcttgcggaaacaagactcccgcccacacataaaaatgcagctcccggccaccgggcgccggtggctcacgcctgtaatcccaacaccttggg

SEQ ID NO: 130424 - DNA, 138 bp, Homo sapiens
  misc_feature 1..138: note = chr9:971434-971572
  misc_feature 1..138: note = Hyper
  source 1..138: mol_type = genomic DNA
aaaatatgcagccccctccgctccacttgaactttaatgctgaaccggtttcccacgtatacgtgtatcgcaccgcattttgacgctttgcatcgagtcgcattaatggcgcttttgagaacgcgtcgtcgcgcttta

SEQ ID NO: 130425 - DNA, 1437 bp, Homo sapiens
  misc_feature 1..1437: note = chr9:971852-973289
  misc_feature 1..1437: note = Hyper
  source 1..1437: mol_type = genomic DNA
tacccctcccccacccgcctgccctcgggagcgggtcgcctccactccaccacctgtttaagttcctccccctcggcgcccctccagtccccaccccggccccggtccaaaaaaccagcaaacggaacttttccacagttgaaagccgcggcccgcgaggccgggctgggaggggaaagcggggcgtgtctggggggcggggccccgagcactccggaagttgccccgcccaggaggctcctgggaaagtgaggagagggcccgggcctactttcgtcctggtgtggcgcccctcagcctcccctcctcccagttcccgcgcctccgcagggcgcctcggcctggcctccaggcaaagttcgcgccccctgttcctggggtgtcggccgcgcgggccgtttcccttcattactcccgggcccctgaatccgaacgctttcccagaagcgcgcaaatccgcttgctttccccgcggctgggctttgttcagggacagcaaaggaggaggcgggaggctggtgaggttttctggaaaaggggcttgtcccgaggaggaagtgccccagatccctgagagccaacgctctggggagaagaaactttccttctcccttgaatgttgctcagattacctaaaattattttttcagcccttgtgttctaaagtcgcagggtaaaggttatcttaagacttaacatcagcgctgctcatttgtacgttggtggagacgtgccttttttcctttgcacttaaggtggacagggtctgcgacgctcccttccaggacggtgtggggaagcggccgacgtccccagccggactcacgccctcctactactgggcgtcggctccgccgcgggcgctcccgacagggagctggagtcggacgagcggctgcccccagggcctccaggaaccgcggcccagcggggagcgccccaggctagcgcttttccagttcccttcgaaagcgcggggctgaggtcgcggcgctgggccctcggatgaagccgtgctgtagctacacctgaaccccgcgaaaggctggcgcggtcgtgtatccaggctgggtctgaggaatccgcaagcgggagagcgctaactcctaggcgtgagccgctgctggcttcgagagttcgagaacatgaaggacctggcttctcccgcccggtcggcttagggccagcgaggtcacaggccgttctgctctccctgtttgtccccaaaggcctcggcacgtggggatctggagcaggcctcaggctgcgacccgtctcttcccctaccaaaattatgtgggaacagcggtccaggaccttcccctgttcagcggtatccccgggccggtgaccccggggttcagtcgtctccccgaccccaagcggcctctgctttccacccctcgccccggagggcggcttcggggatctcatggg

SEQ ID NO: 130426 - DNA, 43 bp, Homo sapiens; identical to SEQ ID NO: 32349
  misc_feature 1..43: note = chr9:973762-973805
  misc_feature 1..43: note = Hyper
  source 1..43: mol_type = genomic DNA

SEQ ID NO: 130427 - DNA, 1628 bp, Homo sapiens
  misc_feature 1..1628: note = chr9:975333-976961
  misc_feature 1..1628: note = Hyper
  source 1..1628: mol_type = genomic DNA
cagcggacttgcctacgctctcatctagcatttgattccccaccaggagatgggcttggtgcacgctctcagaagcgcatccaccgaaggctctggaactgccccgcttcgcatagagctattgtgctgccctgcagtgtatccacttgttttgtttgtttgtttgttttttggtttttgcttgtttgctgatgggcagtggggaggtgcgagggtggagggccttctttgtgcatatatagcgatagtctgcactaggccaagcccgctactcctgggagaatgggaacacgcaaataatctaaacaaagttttctgctgtcatcttgtgaaggaccctctcccccaagacatctatgactggggtctatgggttaaggaggtgaaaaagtggccccatcccatatccataactgaatcacagaatccgtggggatttgaactgagtggctggcgcaagacctccgtttgcttccagtagctgctgggagcgagggaagaggatatcggtaactttgggggcgccaatgtggcttctgtgtctgccccttgaaagtttatacccggcgcttaacaaatcctttacaggagcacgtacgtccctgacctttcaggatactgttttatattaaaacatggacaggagggtagaaaagtaaaattcgcctgcaaaatggcttgtcatccttgggccggcagatctccaaaaccattttcttctaaagcaacaaaagagaaaaaaatacgttctaaaaggaaattacgaaaagagcctaactttcctaaaccaacatcacttcactcccctatcctaaactccacccaggtccggggtgcaaccgcaacactcccgtaggttcgagttctcccggagctgagcttctgcggccaaatgtcgggataaaagcggccttgggctcggaaaaacgcggccagatctggactggagggaggagaagagagagaagcggagcggccacctcactcgcttacaggcacccccaccctcactcccgctggtcctccccttctccgccccgcgagcaccgccgcgttctggagcgccgcagtctccagccgcgggctggggtagcggagagggcttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcggcggaggtgttgggtccggccggctcacgagggagctgcagaagagctggctcagaccttaatcagagctgtcgccggctccttgcagccgccgcagcgcctccgcgaaggaggacgtgccgacccggctgcgcgcccaaggcagaggcccgcgtcggcgttggctgggcgtgagctgggaggccgagctgtgagcgcgaagggagctggagagacgactgcggcacctccggccgccccggagcacacacgaccaccggggctgcgggaccaagggccgcgtcgcccggaggccgcccctgagcgggcctcgcagccccgccgtccagcgctccctggccctc

SEQ ID NO: 130428 - DNA, 432 bp, Homo sapiens; identical to SEQ ID NO: 101388
  misc_feature 1..432: note = chr9:977171-977603
  misc_feature 1..432: note = Hyper
  source 1..432: mol_type = genomic DNA

SEQ ID NO: 130429 - DNA, 287 bp, Homo sapiens; identical to SEQ ID NO: 101400
  misc_feature 1..287: note = chr9:981609-981896
  misc_feature 1..287: note = Hyper
  source 1..287: mol_type = genomic DNA

SEQ ID NO: 130430 - DNA, 660 bp, Homo sapiens
  misc_feature 1..660: note = chr9:1042326-1042986
  misc_feature 1..660: note = Hyper
  source 1..660: mol_type = genomic DNA
tggaagggtctgacacggaatctgaccaaggctggaccctcaataattgtgatttcttttcccccttttccttcttggtaaaatcatcccacgaatctacgcaagtagggcccttcgtcattcttcggagtagccgcttgagggctggaaggagcagtgatagaaaccccagagacgcagagaccctccgaacttcgaactcgatcactgtcctcccccgaccgccgaacccgctggagaagcgggcgcgacagggcgatgagttaacgcggagggagcgcggaggccgcggaagccgggggcgctgggtctcaggcccggatgctgagcgcggaccggcgtgtcctccccacagcgcccccgcgcggcctcctcccgctgcgccccgcacggcgacccgccgcgggtagccctggcgtttggccacgccgtcggctgaggaccgctagagctggggggagatcaaagcattcctatggggcccaaagagcctgggattgcagtgttgttagcctggcctcgccgcgtcaataaattttcggcgaaagttgggagcaggagtggaggcttggggcgggggttggtggggcgcgggggttggccggagggagggtccgggggtttcttgcacctgcgctcctgccgcgttaagtcagtggg

SEQ ID NO: 130431 - DNA, 805 bp, Homo sapiens
  misc_feature 1..805: note = chr9:1051513-1052318
  misc_feature 1..805: note = Hyper
  source 1..805: mol_type = genomic DNA
agggatggtccctgacggcggccggtgggtctttggatttctttgtgtttccccagagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggtgcgtacccgcccggcccgggcgtctcaggccacagtggaggtgggggagttggaggggagcggggcggccgtccacaccccccgcgcccagggccttgcggtgcctggcactccctaggaaggatggtaagaacgcttttctgcttgcactggcgagcagggtcgggagggaaaaagc

SEQ ID NO: 130432 - DNA, 143 bp, Homo sapiens; identical to SEQ ID NO: 100978
  misc_feature 1..143: note = chr9:2178015-2178158
  misc_feature 1..143: note = Hypo
  source 1..143: mol_type = genomic DNA

SEQ ID NO: 130433 - DNA, 433 bp, Homo sapiens; identical to SEQ ID NO: 101012
  misc_feature 1..433: note = chr9:2621293-2621726
  misc_feature 1..433: note = Hyper
  source 1..433: mol_type = genomic DNA

SEQ ID NO: 130434 - DNA, 60 bp, Homo sapiens; identical to SEQ ID NO: 101013
  misc_feature 1..60: note = chr9:2622196-2622256
  misc_feature 1..60: note = Hyper
  source 1..60: mol_type = genomic DNA

SEQ ID NO: 130435 - DNA, 80 bp, Homo sapiens; identical to SEQ ID NO: 101014
  misc_feature 1..80: note = chr9:2622942-2623022
  misc_feature 1..80: note = Hyper
  source 1..80: mol_type = genomic DNA

SEQ ID NO: 130436 - DNA, 43 bp, Homo sapiens; identical to SEQ ID NO: 101015
  misc_feature 1..43: note = chr9:2623460-2623503
  misc_feature 1..43: note = Hyper
  source 1..43: mol_type = genomic DNA

SEQ ID NO: 130437 - DNA, 35 bp, Homo sapiens; identical to SEQ ID NO: 42102
  misc_feature 1..35: note = chr9:2727012-2727047
  misc_feature 1..35: note = Hypo
  source 1..35: mol_type = genomic DNA

SEQ ID NO: 130438 - DNA, 30 bp, Homo sapiens; identical to SEQ ID NO: 101029
  misc_feature 1..30: note = chr9:2933843-2933873
  misc_feature 1..30: note = Hypo
  source 1..30: mol_type = genomic DNA

SEQ ID NO: 130439 - DNA, 756 bp, Homo sapiens; identical to SEQ ID NO: 101031
  misc_feature 1..756: note = chr9:3181124-3181880
  misc_feature 1..756: note = Hyper
  source 1..756: mol_type = genomic DNA

SEQ ID NO: 130440 - DNA, 194 bp, Homo sapiens; identical to SEQ ID NO: 101075
  misc_feature 1..194: note = chr9:3534456-3534650
  misc_feature 1..194: note = Hypo
  source 1..194: mol_type = genomic DNA

SEQ ID NO: 130441 - DNA, 50 bp, Homo sapiens; identical to SEQ ID NO: 101134
  misc_feature 1..50: note = chr9:4298596-4298646
  misc_feature 1..50: note = Hyper
  source 1..50: mol_type = genomic DNA

SEQ ID NO: 130442 - DNA, 1157 bp, Homo sapiens; identical to SEQ ID NO: 101135
  misc_feature 1..1157: note = chr9:4299009-4300166
  misc_feature 1..1157: note = Hyper
  source 1..1157: mol_type = genomic DNA

SEQ ID NO: 130443 - DNA, 30 bp, Homo sapiens; identical to SEQ ID NO: 101139
  misc_feature 1..30: note = chr9:4864629-4864659
  misc_feature 1..30: note = Hypo
  source 1..30: mol_type = genomic DNA

SEQ ID NO: 130444 - DNA, 17 bp, Homo sapiens
  misc_feature 1..17: note = chr9:5230606-5230623
  misc_feature 1..17: note = Hypo
  source 1..17: mol_type = genomic DNA
caaacctttttgaaacg

SEQ ID NO: 130445 - DNA, 169 bp, Homo sapiens; identical to SEQ ID NO: 101142
  misc_feature 1..169: note = chr9:5864501-5864670
  misc_feature 1..169: note = Hypo
  source 1..169: mol_type = genomic DNA

SEQ ID NO: 130446 - DNA, 329 bp, Homo sapiens; identical to SEQ ID NO: 32367
  misc_feature 1..329: note = chr9:6412571-6412900
  misc_feature 1..329: note = Hyper
  source 1..329: mol_type = genomic DNA

SEQ ID NO: 130447 - DNA, 257 bp, Homo sapiens
  misc_feature 1..257: note = chr9:6644297-6644554
  misc_feature 1..257: note = Hyper
  source 1..257: mol_type = genomic DNA
tgagagcaccctggccggtgagagggtgcctgggaagtggggaatctgctacaaaacgcaggggaagctcgcgggggccctaggataaagaccaagaaccgcacaacaccgactctctcctaacacaaaactgtctgctccgagaaccaaatatcccaccttcccgcggctccggaggtacccgccactgttttattttaatccacacattcccagtcctgagcaatccttaccccagagctcgattttcagggaac

SEQ ID NO: 130448 - DNA, 1305 bp, Homo sapiens; identical to SEQ ID NO: 101147
  misc_feature 1..1305: note = chr9:6644869-6646174
  misc_feature 1..1305: note = Hyper
  source 1..1305: mol_type = genomic DNA

SEQ ID NO: 130449 - DNA, 157 bp, Homo sapiens; identical to SEQ ID NO: 101152
  misc_feature 1..157: note = chr9:6704461-6704618
  misc_feature 1..157: note = Hyper
  source 1..157: mol_type = genomic DNA

SEQ ID NO: 130450 - DNA, 76 bp, Homo sapiens; identical to SEQ ID NO: 101153
  misc_feature 1..76: note = chr9:6756353-6756429
  misc_feature 1..76: note = Hypo
  source 1..76: mol_type = genomic DNA

SEQ ID NO: 130451 - DNA, 76 bp, Homo sapiens; identical to SEQ ID NO: 101154
  misc_feature 1..76: note = chr9:6756729-6756805
  misc_feature 1..76: note = Hypo
  source 1..76: mol_type = genomic DNA

SEQ ID NO: 130452 - DNA, 30 bp, Homo sapiens; identical to SEQ ID NO: 15216
  misc_feature 1..30: note = chr9:7164747-7164777
  misc_feature 1..30: note = Hypo
  source 1..30: mol_type = genomic DNA

SEQ ID NO: 130453 - DNA, 1247 bp, Homo sapiens
  misc_feature 1..1247: note = chr9:8857443-8858690
  misc_feature 1..1247: note = Hyper
  source 1..1247: mol_type = genomic DNA
gagaggacctctgcccgaggaggtccagaggagcaaactgtgcgctccggtgcccgggcgccgggctcgcggaaacgcgagcgtgtcgctctggctcgggaggcgccggcagccggagccgggcgcagggcgattccggagcagcaagaggggaagacaccgcggggcggacggggtcagttccagggactcacctggtcatgttggccccgggcagccgccgccaccgcctcccgcgccgccgccaacactttcctccagcgccttcgcgccccgccacggccgcgccgccgcctccgggcggccaatttaatcccgcggagcagcggccgccgccgccgaagcccccctggtcgccgccgccgcccagccctcgtgcggccagcccagtccagagcgaggaagtggaagagagtcagcgagtgagtccaaaaacccgaaatccagcatccaaggcagcgcgtccccccgccctccctccacccctacccccttttcctcctcctccgcctcctcctcctcttcccgggccgtcctcttggcccttctgagcccgcggcttccgcggcggtttctcctcctcccgctcctcctgctcgccctgcgcccgcttctctcgctgccgccgccgccgctgtttgtctcctccccctcctcctcctcctcctcttcctcctcctcccgctcctcgatgctccgccgctcgcggctggggggtccggggccgcgtctcctctcctccctccgcctctcctctttcctccttcctgctgcctcttcttttaaagcggattctttggccacaaatagcaactcggctgcccccctcggtgcctccctccccttctcttcttccccccaaaagtgaagcgcacgcgaggtaaccagaaactgaggctcgtggggggagaggggtgcgaggcgacgcctgggaaagggcccgagcagagtcgagggccgggaggtggggtggccggtgcagcccagtctttggacctggcttgaacctggtagttacggctgcagaagaggtggtttggggaggggggaaaattaaacgaaaaagcccaggaaagtcattggaaaggcttctctctttgtttccttgtgtgggtgatttctaaaatcctcgtaacgtgctggggatcccacggaattgctgtgctccagcgctgggggattgtgtgtgcgcgttgcctgcgcgtgagtgtgagtgtgggtgcgcccggacgcggggagagctgggc

SEQ ID NO: 130454 - DNA, 170 bp, Homo sapiens; identical to SEQ ID NO: 101372
  misc_feature 1..170: note = chr9:9719642-9719812
  misc_feature 1..170: note = Hypo
  source 1..170: mol_type = genomic DNA

SEQ ID NO: 130455 - DNA, 19 bp, Homo sapiens
  misc_feature 1..19: note = chr9:9980357-9980376
  misc_feature 1..19: note = Hypo
  source 1..19: mol_type = genomic DNA
caggaattgggaggccgag

SEQ ID NO: 130456 - DNA, 615 bp, Homo sapiens
  misc_feature 1..615: note = chr9:10612684-10613299
  misc_feature 1..615: note = Hyper
  source 1..615: mol_type = genomic DNA
tacctgcactctccccgccgaggctggctggcggcgccgcgccggaggggaggaggctcgggaggaggaggagaaagagcagcgggaggactcgggctgggaggggagcgcagggttggggaggccgatgagcggctcccggctcctcggagaagcagccgagacggcaaggaggaggcgaggctctgtcggggcgaggcgctgcccccacgcgctccggccgccggctgcgggcgcggctgggcggggagccgaggcggccgctcccgcactcgctcgctcgctcgctggcgctccctcctcgtctcgctcgcactcacaggcacacaccccacgtctccagcagctgccgctcggcctcacgcactcacctgcatttccttaacgagccacttgatggctgccagcggcgtgggccccgctccggcgggcgggggccggggcggggagaacgcggcgcgggatgctccgagcgcccgctggggagagaagcggcggcggcggcggcgctgcgggcgcgccagatggggcgggaggaggggagacccggcacccaccggcccagagctgcctgacgcggcctgggcggaccccgccgcccgggtgcctaggcac

SEQ ID NO: 130457 - DNA, 18 bp, Homo sapiens
  misc_feature 1..18: note = chr9:11196695-11196713
  misc_feature 1..18: note = Hypo
  source 1..18: mol_type = genomic DNA
agtgagaggtgacagcgt

SEQ ID NO: 130458 - DNA, 32 bp, Homo sapiens; identical to SEQ ID NO: 100220
  misc_feature 1..32: note = chr9:11733761-11733793
  misc_feature 1..32: note = Hypo
  source 1..32: mol_type = genomic DNA

SEQ ID NO: 130459 - DNA, 162 bp, Homo sapiens; identical to SEQ ID NO: 100321
  misc_feature 1..162: note = chr9:12775664-12775826
  misc_feature 1..162: note = Hyper
  source 1..162: mol_type = genomic DNA

SEQ ID NO: 130460 - DNA, 53 bp, Homo sapiens; identical to SEQ ID NO: 100322
  misc_feature 1..53: note = chr9:12776163-12776216
  misc_feature 1..53: note = Hyper
  source 1..53: mol_type = genomic DNA

SEQ ID NO: 130461 - DNA, 30 bp, Homo sapiens; identical to SEQ ID NO: 100434
  misc_feature 1..30: note = chr9:13278312-13278342
  misc_feature 1..30: note = Hyper
  source 1..30: mol_type = genomic DNA

SEQ ID NO: 130462 - DNA, 221 bp, Homo sapiens; identical to SEQ ID NO: 100435
  misc_feature 1..221: note = chr9:13278735-13278956
  misc_feature 1..221: note = Hyper
  source 1..221: mol_type = genomic DNA

SEQ ID NO: 130463 - DNA, 103 bp, Homo sapiens; identical to SEQ ID NO: 100436
  misc_feature 1..103: note = chr9:13279303-13279406
  misc_feature 1..103: note = Hyper
  source 1..103: mol_type = genomic DNA

SEQ ID NO: 130464 - DNA, 116 bp, Homo sapiens; identical to SEQ ID NO: 32380
  misc_feature 1..116: note = chr9:13279633-13279749
  misc_feature 1..116: note = Hyper
  source 1..116: mol_type = genomic DNA

SEQ ID NO: 130465 - DNA, 70 bp, Homo sapiens; identical to SEQ ID NO: 100554
  misc_feature 1..70: note = chr9:13568991-13569061
  misc_feature 1..70: note = Hyper
  source 1..70: mol_type = genomic DNA

SEQ ID NO: 130466 - DNA, 69 bp, Homo sapiens; identical to SEQ ID NO: 100938
  misc_feature 1..69: note = chr9:14313027-14313096
  misc_feature 1..69: note = Hyper
  source 1..69: mol_type = genomic DNA

SEQ ID NO: 130467 - DNA, 30 bp, Homo sapiens; identical to SEQ ID NO: 100939
  misc_feature 1..30: note = chr9:14315920-14315950
  misc_feature 1..30: note = Hyper
  source 1..30: mol_type = genomic DNA

SEQ ID NO: 130468 - DNA, 248 bp, Homo sapiens; identical to SEQ ID NO: 100940
  misc_feature 1..248: note = chr9:14347425-14347673
  misc_feature 1..248: note = Hyper
  source 1..248: mol_type = genomic DNA

SEQ ID NO: 130469 - DNA, 345 bp, Homo sapiens; identical to SEQ ID NO: 3394
  misc_feature 1..345: note = chr9:14348107-14348452
  misc_feature 1..345: note = Hyper
  source 1..345: mol_type = genomic DNA

SEQ ID NO: 130470 - DNA, 30 bp, Homo sapiens; identical to SEQ ID NO: 100942
  misc_feature 1..30: note = chr9:14974087-14974117
  misc_feature 1..30: note = Hypo
  source 1..30: mol_type = genomic DNA

SEQ ID NO: 130471 - DNA, 17 bp, Homo sapiens
  misc_feature 1..17: note = chr9:15277136-15277153
  misc_feature 1..17: note = Hypo
  source 1..17: mol_type = genomic DNA
aatttatgggctgggcg

SEQ ID NO: 130472 - DNA, 27 bp, Homo sapiens
  misc_feature 1..27: note = chr9:15488010-15488037
  misc_feature 1..27: note = Hypo
  source 1..27: mol_type = genomic DNA
agaaataaaatttatcggtttaaaagt

SEQ ID NO: 130473 - DNA, 27 bp, Homo sapiens
  misc_feature 1..27: note = chr9:15513969-15513996
  misc_feature 1..27: note = Hypo
  source 1..27: mol_type = genomic DNA
tactcaataaaaaagcgccggacgcgg

SEQ ID NO: 130474 - DNA, 29 bp, Homo sapiens
  misc_feature 1..29: note = chr9:15533122-15533151
  misc_feature 1..29: note = Hypo
  source 1..29: mol_type = genomic DNA
cccggccagaaagacgtgtttactacaaa

SEQ ID NO: 130475 - DNA, 30 bp, Homo sapiens; identical to SEQ ID NO: 100947
  misc_feature 1..30: note = chr9:16133835-16133865
  misc_feature 1..30: note = Hyper
  source 1..30: mol_type = genomic DNA

SEQ ID NO: 130476 - DNA, 105 bp, Homo sapiens
  misc_feature 1..105: note = chr9:16154666-16154771
  misc_feature 1..105: note = Hyper
  source 1..105: mol_type = genomic DNA
ctgagcgcagctcctcgccgctcggccatctggcgcgctcccgctccctccacccttctgtcgctcacctggtggagcgcggcccggggacggcagggggcggct

SEQ ID NO: 130477 - DNA, 58 bp, Homo sapiens; identical to SEQ ID NO: 100950
  misc_feature 1..58: note = chr9:16435989-16436047
  misc_feature 1..58: note = Hypo
  source 1..58: mol_type = genomic DNA

SEQ ID NO: 130478 - DNA, 33 bp, Homo sapiens; identical to SEQ ID NO: 100951
  misc_feature 1..33: note = chr9:16726995-16727028
  misc_feature 1..33: note = Hyper
  source 1..33: mol_type = genomic DNA

SEQ ID NO: 130479 - DNA, 30 bp, Homo sapiens; identical to SEQ ID NO: 100952
  misc_feature 1..30: note = chr9:16727304-16727334
  misc_feature 1..30: note = Hyper
  source 1..30: mol_type = genomic DNA

SEQ ID NO: 130480 - DNA, 120 bp, Homo sapiens; identical to SEQ ID NO: 100953
  misc_feature 1..120: note = chr9:16813180-16813300
  misc_feature 1..120: note = Hypo
  source 1..120: mol_type = genomic DNA

SEQ ID NO: 130481 - DNA, 349 bp, Homo sapiens; identical to SEQ ID NO: 100954
  misc_feature 1..349: note = chr9:16869976-16870325
  misc_feature 1..349: note = Hyper
  source 1..349: mol_type = genomic DNA

SEQ ID NO: 130482 - DNA, 566 bp, Homo sapiens; identical to SEQ ID NO: 100955
  misc_feature 1..566: note = chr9:16870633-16871199
  misc_feature 1..566: note = Hyper
  source 1..566: mol_type = genomic DNA

SEQ ID NO: 130483 - DNA, 684 bp, Homo sapiens; identical to SEQ ID NO: 100956
  misc_feature 1..684: note = chr9:16871415-16872099
  misc_feature 1..684: note = Hyper
  source 1..684: mol_type = genomic DNA

SEQ ID NO: 130484 - DNA, 30 bp, Homo sapiens; identical to SEQ ID NO: 100957
  misc_feature 1..30: note = chr9:16933048-16933078
  misc_feature 1..30: note = Hypo
  source 1..30: mol_type = genomic DNA

SEQ ID NO: 130485 - DNA, 38 bp, Homo sapiens; identical to SEQ ID NO: 100958
  misc_feature 1..38: note = chr9:16964538-16964576
  misc_feature 1..38: note = Hypo
  source 1..38: mol_type = genomic DNA

SEQ ID NO: 130486 - DNA, 739 bp, Homo sapiens; identical to SEQ ID NO: 100959
  misc_feature 1..739: note = chr9:17135031-17135770
  misc_feature 1..739: note = Hyper
  source 1..739: mol_type = genomic DNA

SEQ ID NO: 130487 - DNA, 1042 bp, Homo sapiens
  misc_feature 1..1042: note = chr9:17578706-17579748
  misc_feature 1..1042: note = Hyper
  source 1..1042: mol_type = genomic DNA
gtctttttcaggctgcggcgcagagacgccaggctcaaagggcaggagggccgtctgcaggcagcgccgccgcggctacctggaagcccagcaagtcacctgagtcctgcgggtgcctgggctgccaatctgcagcgacccgtccgcagcccccgggggcaggaacaccaaccccgggacaggaggacgtcctcggcccgctgactagggatccgccagcgggtgccgctgagccacatccccgcagttggcgccagcatccaggtaccgcgcgccacagcacctgcctgggcgttcccgcgcttggggcggggcttcccgcgtcccctttaagaggccgcatcacccgcccttgacgtcagagtgtttctccgcaagagcccgtgtcccgctaggctccgcgccctcgcgcccatagccccggcggcggcacgaccagaggcggccaggggagcgcgccgccccgctcggccctccagtccccctccgcctcctccctcccgcacagcagccgccagcgcggcctcctgcaccatgtcggtggccggcctcaagaagcagttccataaagccactcaggtaaggcgcgcggcaggtgcgtcccggggcagtccggggcgaagctgcgaggggcgcgctcggcgctggccgtccggcggcagcttggggagttcggcaccgagcctcgcccgcgccggccgcgccccgcctcgcaagccaaggcggcggctcggggcatccccggtctgggcgtccaccctcggtcccccgcccccggcttggtgcgcgctgccttcccgcgggtccccggcgtcctgcctggtagcgctgctcgccgcccccgcatcatctcgcgcccgtgctgcaggaaggggaccgcggctgcactgctgccgcggcgcgcaggtgccttggcggcgcggtgggagattatgtaaagtcgcctcttcacgggtgaccttgcggagtcggtgcacccggctttcccgggatgtgttggcatgagcggtggccgcactgggggtggcggggcggaggccgg

SEQ ID NO: 130488 - DNA, 668 bp, Homo sapiens
  misc_feature 1..668: note = chr9:17906058-17906726
  misc_feature 1..668: note = Hyper
  source 1..668: mol_type = genomic DNA
gaaaagctccatgagcgcccaggggacaagtccccacggacaaacatgtcataacgatttcagttttgtcccattacgtgaggttgtaagtttcttcatcattcccccctcccaacaagcacaaaatcgtccccagcccctggagcatcttgcggggctcccaggtcagcaacagcactcggagctccgagctccagggaaagcgctcagggaatggctcctaggactggttcctgggaaagcgccagcgtccagggagagatttccttctccaagggccggcagggtggcattccaagcgcgagcaaggtgggcagtgagcgatcctccctttaaaaaagaataaataaatagaagccagcgcgcagccccgctcgggtttcccgaagcgcacaccgctgtcgctgccggggcggctggatgtctgcgctccccgcctccgctgggctgacacgggaggggaggagcaggagctggaggggtgttgggggtggggggagcgcgaaccatctcgagccaagacaagcagcacattcacaaataacgcccccacccccagcgcacgcgctcccattcaaagcagacccgctccgcggccgcactgaagctccaaagccgcgccgcctgccccagcgcagctctgtctcgtggggcgcacgcccgagccc

SEQ ID NO: 130489 - DNA, 578 bp, Homo sapiens
  misc_feature 1..578: note = chr9:17906983-17907561
  misc_feature 1..578: note = Hyper
  source 1..578: mol_type = genomic DNA
cgaaaagcgctacagcgtgggaggtgctctcttccgcgaaggtccatcctggggctgcgctgccgcccaggctggggacaagtggcgcggggttggggctaaggcgtaccctggggtcgatcgggtcgatctctgcgtttaggcttgacccagcttcctgggaccctgtcctggcttttcgcccttacctgggtcctgcttccagccaggcagagccggggcgagaaggcggcgcctgagctggggagctgtcatccccaacagtcctctaccccccaccctttccgacagtccttcgcggagccccctctctcgttccaggctgaggcttgggcggcgccggggacactcgggtgctgggacactcctccacacttccgcccttctgcggacctagtgaacttctgacactgtcaccctagggccgcccgcagccgagtgtcgggggcgcagcgttgtaatgtgtgcggacgccggaccaggtgggctccctggtgcctccgcggtctagaggtggctctggtgggtgggtgcccgaggattggccctgaccataccccctccgaatcctcccaggg

SEQ ID NO: 130490 - DNA, 273 bp, Homo sapiens
  misc_feature 1..273: note = chr9:19127231-19127504
  misc_feature 1..273: note = Hyper
  source 1..273: mol_type = genomic DNA
ccaggacctggaagccgcgaggcgagcggggggtctcggaccatcacccccgcgtcccgtccacctttgagccccgcggggagcagagcagcggtcccaaggccccggggagccccccaccccaactgggcgccgctgggggcccgggaccggttcgctggggcacccactgggcgcgcactcaccgacggactgcagcgaaaggcgaagagcaggcgcgtcccgaagacgactccggctgccacgacccggtcaaagcgtggggcccgcggg

SEQ ID NO: 130491 - DNA, 30 bp, Homo sapiens; identical to SEQ ID NO: 100967
  misc_feature 1..30: note = chr9:19374806-19374836
  misc_feature 1..30: note = Hypo
  source 1..30: mol_type = genomic DNA

SEQ ID NO: 130492 - DNA, 30 bp, Homo sapiens; identical to SEQ ID NO: 100968
  misc_feature 1..30: note = chr9:19780077-19780107
  misc_feature 1..30: note = Hypo
  source 1..30: mol_type = genomic DNA

SEQ ID NO: 130493 - DNA, 1101 bp, Homo sapiens
  misc_feature 1..1101: note = chr9:19788200-19789301
  misc_feature 1..1101: note = Hyper
  source 1..1101: mol_type = genomic DNA
actcctgagataacccgaccccatcacggagattcccaggtggctgcgaacgtcaacgcttagcaggaacgattaagcgattcacagcactcaggggattgtgtaaatgcccggcccgggcgaccagcagggacagattcaactccccgggcgcaaagtcatctccagcccgatcctcgctccccctgaaaacccaccgctcgtctccccgggagctgcctccgtaggagaatgttcgcccccagccgcgccccaactttgccttgcgtggtcccaaactttccctggtggattaataggaaaataaatctaaaggacagacgccccacctgtgagcttggagctgggttgcatttggtgaggcgcttggcccgcatccccctgagtcgtttgtaggtggctggggaatggaagcgcccctctgcgcgtctcccccgacggcaggccctgccccacgccccccatcccaagccaaaagcaagggtaggagaggcgggggctccaaatccacgccccggagcacagagagttggctaactcctagcggggcctggggcgcccacatccacggcagagccacctgtgagcctgcagagcagcaacgggatgcgcgcaaccgggatgcggggacgaccgccacagcggctacagcggcaggcggggcgcagccgcccgcacttaccaggataagatgggaggacgcgcacacggcggggcccccgagcgcggcccgccgctccagtccgccggccctccgcctacccgctctgaggcccgggctctggctcgcactggctgccgctctcgccagccgggctgggttcgggaggagactgagccgctgtgagcccggcgctccgagtctggcgctgcccggcccccgccggcccctccctctgggctgtgcgctgtgcgctgggagcggggccgcagcgcgctcagctcccgagtcctttgctccacgcctcctgggcgcagaggcgacgctggcagccgtctcttaggagatttctccgcagtgtggacgggggtcaggatttgcaggcgagcaagggcagagaggagaaatcgtacaggtcggtgacgcgcctaattcacaaa

SEQ ID NO: 130494 - DNA, 41 bp, Homo sapiens; identical to SEQ ID NO: 100971
  misc_feature 1..41: note = chr9:20620713-20620754
  misc_feature 1..41: note = Hyper
  source 1..41: mol_type = genomic DNA

SEQ ID NO: 130495 - DNA, 424 bp, Homo sapiens; identical to SEQ ID NO: 32402
  misc_feature 1..424: note = chr9:21031412-21031836
  misc_feature 1..424: note = Hyper
  source 1..424: mol_type = genomic DNA

SEQ ID NO: 130496 - DNA, 328 bp, Homo sapiens; identical to SEQ ID NO: 100973
  misc_feature 1..328: note = chr9:21395999-21396327
  misc_feature 1..328: note = Hyper
  source 1..328: mol_type = genomic DNA

SEQ ID NO: 130497 - DNA, 706 bp, Homo sapiens; identical to SEQ ID NO: 100974
  misc_feature 1..706: note = chr9:21402440-21403146
  misc_feature 1..706: note = Hyper
  source 1..706: mol_type = genomic DNA

SEQ ID NO: 130498 - DNA, 97 bp, Homo sapiens; identical to SEQ ID NO: 100976
  misc_feature 1..97: note = chr9:21559247-21559344
  misc_feature 1..97: note = Hyper
  source 1..97: mol_type = genomic DNA

SEQ ID NO: 130499 - DNA, 343 bp, Homo sapiens; identical to SEQ ID NO: 100977
  misc_feature 1..343: note = chr9:21559775-21560118
  misc_feature 1..343: note = Hyper
  source 1..343: mol_type = genomic DNA

SEQ ID NO: 130500 - DNA, 875 bp, Homo sapiens
  misc_feature 1..875: note = chr9:21964911-21965786
  misc_feature 1..875: note = Hyper
  source 1..875: mol_type = genomic DNA
tttctgctatttcctgaactttattacgtaaatgagacacgtgagatctggaaggaggtggaggtgaagaccctcccacctggcctgcatccagagtacttggggtgtggcactggcgtgggccccaggaaggatcccagccagttttggtgctggaggcccggccaaaggaagggctgctctcccgtcccgcgggctccgaggtcgccgcacccgggcgcgcctgggcctcgtcacccgcgctcgtgacgcgtgcttacaaaggaaacttttacaggtttcggtgggcagggccttttattgcccttctgctccacagcccccgtgcttaatcggttggttgggaggtttctttcgtccgtggttttggaaagtccccgcctccaaaccgcagtcccgcagtcagttctgcagcctcagggcctcgaacagccatgcttagaatccgtccttctttcctgctccatctacccttcccctctggcttcttttttttcactggagaaagcccacccgagtctctcagcctgcttcggaggttactgcggcctcctccacgggtagttctgggacccgggtctagtccgcggttccggagcaggtccctccctggagtcgtcaggcccagtatgcgtgtgctcagtgtgctcgggaaacacgcgtgggctttaacagcagatctccataaaagggtcccggagatagcctctgcctggcccgaggcccagtgcctcaaagcggacgcctttgcgctcccggaggtgctcacaccacagcggagcctgctggcgagtggagcgtaggactgcgaaccagcaatctcccgagaagcggcgagggggaggggaatgtctgtgaatcggttatccctccca

SEQ ID NO: 130501 - DNA, 42 bp, Homo sapiens; identical to SEQ ID NO: 100981
  misc_feature 1..42: note = chr9:21967367-21967409
  misc_feature 1..42: note = Hyper
  source 1..42: mol_type = genomic DNA

SEQ ID NO: 130502 - DNA, 569 bp, Homo sapiens
  misc_feature 1..569: note = chr9:21968159-21968728
  misc_feature 1..569: note = Hyper
  source 1..569: mol_type = genomic DNA
gccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcccgcctggctgctccaggcgcgccgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacg

SEQ ID NO: 130503 - DNA, 92 bp, Homo sapiens; identical to SEQ ID NO: 32411
  misc_feature 1..92: note = chr9:21969169-21969261
  misc_feature 1..92: note = Hyper
  source 1..92: mol_type = genomic DNA

SEQ ID NO: 130504 - DNA, 156 bp, Homo sapiens
  misc_feature 1..156: note = chr9:21969732-21969888
  misc_feature 1..156: note = Hyper
  source 1..156: mol_type = genomic DNA
agctgtaactggagccgaagtctccttcttcacctcccgggacctggatgctagctgtaactggagggaattggcgggggggaggggaggaggggccgagtaaagaagaacttcgcgtctttaacttcgaaggtgattttgcgttctgtatttaca

SEQ ID NO: 130505 - DNA, 166 bp, Homo sapiens
  misc_feature 1..166: note = chr9:21970940-21971106
  misc_feature 1..166: note = Hyper
  source 1..166: mol_type = genomic DNA
gcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcg

SEQ ID NO: 130506 - DNA, 68 bp, Homo sapiens
  misc_feature 1..68: note = chr9:21971135-21971203
  misc_feature 1..68: note = Hyper
  source 1..68: mol_type = genomic DNA
gtcggcgcagttgggctccgcgccgtggagcagcagcagctccgccactcgggcgctgcccatcatca

SEQ ID NO: 130507 - DNA, 1532 bp, Homo sapiens
  misc_feature 1..1532: note = chr9:21974163-21975695
  misc_feature 1..1532: note = Hyper
  source 1..1532: mol_type = genomic DNA
acaaggcgtgaggcaccgcgcccggccgcttctgaataatttcgatcaaaatttatattcgatatttattccaacatacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttcccaagcccccagggcgtcgccaggaggaggtctgtgattacaaaccccttctgaaaactccccaggaagcctcccctttttccggagaatcgaagcgctacctgattccaattcccctgcaaacttcgtcctccagagtcgcccgccatcccctgctcccgctgcagaccctctacccacctggatcggcctccgaccgtaactattcggtgcgttgggcagcgcccccgcctccagcagcgcccgcacctcctctacccgaccccgggccgcggccgtggccagccagtcagccgaaggctccatgctgctccccgccgccggctccatgctgctccccgccgcccgctgcctgctctccccctctccgcagccgccgagcgcacgcggtccgccccaccctctggtgaccagccagcccctcctctttcttcctccggtgctggcggaagagccccctccgaccctgtccctcaaatcctctggagggaccgcggtatctttccaggcaaggggacgccgtgagcgagtgctcggaggaggtgctattaactccgagcacttagcgaatgtggcacccctgaagtcgccccaggttgggtctcccccgggggcaccagccggaagcagccctcgccagagccagcgttggcaaggaaggaggactgggctcctccccacctgccccccacaccgccctccggcctccctgctcccagccgcgctcccccgcctgccagcaaaggcgtgtttgagtgcgttcactctgttaaaaagaaatccgcccccgccccgtttccttcctccgcgatacaaccttcctaactgccaaattgaatcggggtgtttggtgtcatagggaaagtatggcttcttcttttaatcataagaaaaagcaaaactattctttcctagttgtgagagccccaccgagaatcgaaatcacctgtacgactagaaagtgtccccctaccccctcaacccttgattttcaggagcgcggggttcactaagtcagaaaccctagttcaaaggattccttttggagagtcggactgctctctccttcccctccccttcccctcctgcgtgtaaaacggctgtctggggcaagggtttctcagacgtgtacattgcctggtataagagcagactctgaaaagatgaggtttatttaatacggacgggggagaattctg

SEQ ID NO: 130508 - DNA, 29 bp, Homo sapiens
  misc_feature 1..29: note = chr9:21994208-21994237
  misc_feature 1..29: note = Hyper
  source 1..29: mol_type = genomic DNA
gcgggcgcccctggcgctgcccactcccc

SEQ ID NO: 130509 - DNA, 29 bp, Homo sapiens
  misc_feature 1..29: note = chr9:21995297-21995326
  misc_feature 1..29: note = Hyper
  source 1..29: mol_type = genomic DNA
accttcacgacagccgcggagcatctgag

SEQ ID NO: 130510 - DNA, 29 bp, Homo sapiens
  misc_feature 1..29: note = chr9:21995720-21995749
  misc_feature 1..29: note = Hyper
  source 1..29: mol_type = genomic DNA
ccgggtcctgagcgcggtctaagcgaggc

SEQ ID NO: 130511 - DNA, 113 bp, Homo sapiens
  misc_feature 1..113: note = chr9:22006059-22006172
  misc_feature 1..113: note = Hyper
  source 1..113: mol_type = genomic DNA
gacgaccccaggcatcgcgcacgtccagccgcgccccggcccggtgcagcaccaccagcgtgtccaggaagccctcccgggcagcatcatgcaccggtcgggtgagagtggca

SEQ ID NO: 130512 - DNA, 114 bp, Homo sapiens; identical to SEQ ID NO: 100993
  misc_feature 1..114: note = chr9:22010993-22011107
  misc_feature 1..114: note = Hyper
  source 1..114: mol_type = genomic DNA

SEQ ID NO: 130513 - DNA, 351 bp, Homo sapiens; identical to SEQ ID NO: 32417
  misc_feature 1..351: note = chr9:22446925-22447276
  misc_feature 1..351: note = Hyper
  source 1..351: mol_type = genomic DNA

SEQ ID NO: 130514 - DNA, 207 bp, Homo sapiens; identical to SEQ ID NO: 100995
  misc_feature 1..207: note = chr9:22447488-22447695
  misc_feature 1..207: note = Hyper
  source 1..207: mol_type = genomic DNA

SEQ ID NO: 130515 - DNA, 649 bp, Homo sapiens
  misc_feature 1..649: note = chr9:23821013-23821662
  misc_feature 1..649: note = Hyper
  source 1..649: mol_type = genomic DNA
tgttaagtctccaaacgccccgagagctccaaggaccgcgcgcgcgaaggcgccgtagcaagtgggcacacaccagacaccaccccggcgtgttccgcgggagaagccagtgcacacatcctcccgcaaggcggggttgccagtgcaacacaggaatcctgccctttttctagaaaagccccctcccccactttccctccaatacactcacctgcgtctcaacagtttccttcttgcgctacacgcggccgcacccgggcacgtccacgcccgtgcacgctgccaggcgcgactgtccccgctcggctcccgccgcccccaacctgcttgtgcccacgggaggggcggtgccacctcccgaggcgcccaattctctctactcccgccgcaacgggctgagctctaggaacttcgcgggcacaacctccgccgcccccaccagtgttcccgcccagagttcggactagggcgcaccacccctaccctgctagacgcagcgggggcgcgcacagaccttagcctcggcgtccaaaatggaccaggggcaaggcgcggacgccgtccccgcccccacgcccccagcacttgcctgctgtgactcgaagctgcagctactacggctcgtgccgctggccgtcagcactgccgc

SEQ ID NO: 130516 - DNA, 527 bp, Homo sapiens; identical to SEQ ID NO: 100997
  misc_feature 1..527: note = chr9:23822112-23822639
  misc_feature 1..527: note = Hyper
  source 1..527: mol_type = genomic DNA

SEQ ID NO: 130517 - DNA, 579 bp, Homo sapiens; identical to SEQ ID NO: 32421
  misc_feature 1..579: note = chr9:23824012-23824591
  misc_feature 1..579: note = Hyper
  source 1..579: mol_type = genomic DNA

SEQ ID NO: 130518 - DNA, 223 bp, Homo sapiens; identical to SEQ ID NO: 100999
  misc_feature 1..223: note = chr9:23824795-23825018
  misc_feature 1..223: note = Hyper
  source 1..223: mol_type = genomic DNA

SEQ ID NO: 130519 - DNA, 338 bp, Homo sapiens; identical to SEQ ID NO: 101000
  misc_feature 1..338: note = chr9:23825602-23825940
  misc_feature 1..338: note = Hyper
  source 1..338: mol_type = genomic DNA

SEQ ID NO: 130520 - DNA, 182 bp, Homo sapiens; identical to SEQ ID NO: 101001
  misc_feature 1..182: note = chr9:23826293-23826475
  misc_feature 1..182: note = Hyper
  source 1..182: mol_type = genomic DNA

SEQ ID NO: 130521 - DNA, 40 bp, Homo sapiens; identical to SEQ ID NO: 32423
  misc_feature 1..40: note = chr9:23829874-23829914
  misc_feature 1..40: note = Hyper
  source 1..40: mol_type = genomic DNA

SEQ ID NO: 130522 - DNA, 30 bp, Homo sapiens; identical to SEQ ID NO: 32424
  misc_feature 1..30: note = chr9:23830739-23830769
  misc_feature 1..30: note = Hyper
  source 1..30: mol_type = genomic DNA

SEQ ID NO: 130523 - DNA, 384 bp, Homo sapiens
  misc_feature 1..384: note = chr9:23831100-23831484
  misc_feature 1..384: note = Hyper
  source 1..384: mol_type = genomic DNA
ctctggcccctttaccgggacctgggaagaaacggtttttatgcttccgatgctcggaggctctttcttatattgaagatttatgtttccacttgtgtgcgatgcacgtctaatttgaaataataaaaccgggctgagcaaccagtcaatcagagccatccagggcgctccgcacgccgccctgccccccacctccctccggtctctaactctttccctcctcctccccctctcactctcctggccctccccgtcttccttcctccctcctcggctctcacacgcgctcacacttttacccccacgtgtgttcagatcaaacccttgtcccacagagcaagtgccggcaccgggccacggtgacaaaggcggagtttgtatcag

SEQ ID NO: 130524 - DNA, 30 bp, Homo sapiens; identical to SEQ ID NO: 32427
  misc_feature 1..30: note = chr9:23831747-23831777
  misc_feature 1..30: note = Hyper
  source 1..30: mol_type = genomic DNA

SEQ ID NO: 130525 - DNA, 58 bp, Homo sapiens; identical to SEQ ID NO: 101007
  misc_feature 1..58: note = chr9:23849841-23849899
  misc_feature 1..58: note = Hyper
  source 1..58: mol_type = genomic DNA

SEQ ID NO: 130526 - DNA, 117 bp, Homo sapiens; identical to SEQ ID NO: 101008
  misc_feature 1..117: note = chr9:23850410-23850527
  misc_feature 1..117: note = Hyper
  source 1..117: mol_type = genomic DNA

SEQ ID NO: 130527 - DNA, 384 bp, Homo sapiens; identical to SEQ ID NO: 101009
  misc_feature 1..384: note = chr9:23850798-23851182
  misc_feature 1..384: note = Hyper
  source 1..384: mol_type = genomic DNA

SEQ ID NO: 130528 - DNA, 74 bp, Homo sapiens; identical to SEQ ID NO: 101010
  misc_feature 1..74: note = chr9:25678053-25678127
  misc_feature 1..74: note = Hyper
  source 1..74: mol_type = genomic DNA

SEQ ID NO: 130529 - DNA, 19 bp, Homo sapiens
  misc_feature 1..19: note = chr9:26796964-26796983
  misc_feature 1..19: note = Hypo
  source 1..19: mol_type = genomic DNA
aactatttttcaaatcgaa

SEQ ID NO: 130530 - DNA, 30 bp, Homo sapiens; identical to SEQ ID NO: 42109
  misc_feature 1..30: note = chr9:26958024-26958054
  misc_feature 1..30: note = Hypo
  source 1..30: mol_type = genomic DNA

SEQ ID NO: 130531 - DNA, 259 bp, Homo sapiens; identical to SEQ ID NO: 101018
  misc_feature 1..259: note = chr9:26976028-26976287
  misc_feature 1..259: note = Hypo
  source 1..259: mol_type = genomic DNA

SEQ ID NO: 130532 - DNA, 18 bp, Homo sapiens
  misc_feature 1..18: note = chr9:26976347-26976365
  misc_feature 1..18: note = Hypo
  source 1..18: mol_type = genomic DNA
ttgcgcagtagggtgctt

SEQ ID NO: 130533 - DNA, 30 bp, Homo sapiens; identical to SEQ ID NO: 101020
  misc_feature 1..30: note = chr9:27080231-27080261
  misc_feature 1..30: note = Hypo
  source 1..30: mol_type = genomic DNA

SEQ ID NO: 130534 - DNA, 30 bp, Homo sapiens; identical to SEQ ID NO: 101022
  misc_feature 1..30: note = chr9:27282428-27282458
  misc_feature 1..30: note = Hypo
  source 1..30: mol_type = genomic DNA

SEQ ID NO: 130535 - DNA, 36 bp, Homo sapiens; identical to SEQ ID NO: 101023
  misc_feature 1..36: note = chr9:27610868-27610904
  misc_feature 1..36: note = Hypo
  source 1..36: mol_type = genomic DNA

SEQ ID NO: 130536 - DNA, 31 bp, Homo sapiens; identical to SEQ ID NO: 42111
  misc_feature 1..31: note = chr9:28641312-28641343
  misc_feature 1..31: note = Hypo
  source 1..31: mol_type = genomic DNA

SEQ ID NO: 130537 - DNA, 1029 bp, Homo sapiens
  misc_feature 1..1029: note = chr9:29211799-29212828
  misc_feature 1..1029: note = Hyper
  source 1..1029: mol_type = genomic DNA
tcccctagctcacctcggagcagcctggcccagaccaaccacccagcgttctccgcaaaaaacttcccttaaagcagccaaatattcaagggaggcgggggaaattgggcattagttcgaatacacatacaacagagcaccacggagcaacactgaaaggcaccttttttagatacagaccctatagactctctctcacccttcactccctcccaccctgagtatctgactgagaatttacagagaaccaagaggcgaaaggagagtggaggagaaagagggcattacctcccggggctgccctcagggtgcgggtcaggatctcatccccgaagtggctccagttcaaggcacagctttccagagctcagccgggttcggacctgcgtccccgcggcgcggtgcggagctcggaagcgcgccgggactgccgctcacgtcccccgcccctgccgcgcgggctccgccaccccgcgagcacgctggctctccgcgctcaccccgccgcctcctggcgcccccacacccacccgctccgcggcgcccgctgggagcctctagcggaggcgaagggaacagcaggcgacctgcggcgcccaggttccgacgccggttgcagggagccggccaagcggcagcgtgggcttcgcgcgcccccgagtccgcaggccgggtgccgccgccgcccccacctgcccacctgcgccaggctcacctgccaccgcgtcctagttgcgttcaccggtgcccacagctctctatggcaattgggggtgggtctgcggtgctaataaaaatttaaaaaaaaaacctctctggtaaaaaaacgaaaacccaaaacccaaatccacgctgtatatcaacctccacagagaacccagtccgaaatcgttttccaataggtttcagaaagtgtgaggacaggacactcctctggcttcctgcctcgcagctgggcagcgccgcaccggctactccctgacttgccaggcgggtcgtgcgatcgcgtagcgacgcccggagagatcc

SEQ ID NO: 130538 - DNA, 2007 bp, Homo sapiens; identical to SEQ ID NO: 101028
  misc_feature 1..2007: note = chr9:29213127-29215134
  misc_feature 1..2007: note = Hyper
  source 1..2007: mol_type = genomic DNA

SEQ ID NO: 130539 - DNA, 54 bp, Homo sapiens; identical to SEQ ID NO: 101030
  misc_feature 1..54: note = chr9:29826623-29826677
  misc_feature 1..54: note = Hypo
  source 1..54: mol_type = genomic DNA

SEQ ID NO: 130540 - DNA, 20 bp, Homo sapiens
  misc_feature 1..20: note = chr9:32253117-32253137
  misc_feature 1..20: note = Hypo
  source 1..20: mol_type = genomic DNA
gctggaggccgggcgcggtg

SEQ ID NO: 130541 - DNA, 75 bp, Homo sapiens; identical to SEQ ID NO: 101033
  misc_feature 1..75: note = chr9:32755910-32755985
  misc_feature 1..75: note = Hypo
  source 1..75: mol_type = genomic DNA

SEQ ID NO: 130542 - DNA, 1271 bp, Homo sapiens
  misc_feature 1..1271: note = chr9:32782592-32783863
  misc_feature 1..1271: note = Hyper
  source 1..1271: mol_type = genomic DNA
gccagtcttgccccccggggccagaggaatccatctgcccctgcctaccagagcgggaggaacgcaggctctcaatgcctgcttcagcaagggaggagagaatcgcccagagctgagcggcgtcgtagggtggtggtcctgaccggtcaaggccccttctcctcgtgaactgggggccagggagcccttctccctgtccccccggcaccacagcgctgtagaagtgaaatcccggctccaaggtcaccctctcccgagcctggagctggaaagccacggggactccggggactcccccaaggcccggactagcctggcacccacccctcaccactaacccactccgcctgggcgctggttctgtgcgctcccgcggcgcagtcgctccgctgcaagagcgctttcgcgcgccgccaccgcccagagccgggaccaaagcagtcctcgggcaccggctccccgagggacacacacccccccgcgccccgagtcgaggggttgagagaagggcggtcggggagcccctgggcctgccgtcagtcacccggatttgtaactggagaagggtgcgggtcccggagggacatctccagctggcacctaactcctcggatcccggactgggagcccgagctcggatattgcaacggctgccccgtgggcaaaccgaccctggtttccgactccggccactggcagcctcgcgccccagacccttcccgggcacggaagcgggtcaggtcgccctgctcagcctccggaacggcggcggcacaaaccccggccgctcccagcagccccgacgagaccccgggcagcgcctgccgccgggtggcctccctctggggctgaccccctcgcgcccccgcgcgtctgtctgcgtttctgagcctgctctgacagtgatgtaacaaggccaggctcgcgccgcgtcccctctttcccagactcagtgctccctcctcctcccgcgccccgcgctctgcgcgctgagctggcgccgggctccgcttgcacagcaccgggaccgacgggcactgctgggagagccgctctcccaggttccacctccccgatgcagagtccgtgggggaaaccaggctttcctcccagaaccaagggagcgagccgagggggcagctgctgtgggggcttctgaggagacagcctggcttctttccctacttcctggagagggcaggaaacctcaggtacctcgttgaccccagccggagcgtgttgatatgagagagagacggaggttgcaatag

SEQ ID NO: 130543 - DNA, 24 bp, Homo sapiens
  misc_feature 1..24: note = chr9:32828442-32828466
  misc_feature 1..24: note = Hypo
  source 1..24: mol_type = genomic DNA
cagaaaaaaagctctcggccaggc

SEQ ID NO: 130544 - DNA, 420 bp, Homo sapiens; identical to SEQ ID NO: 101039
  misc_feature 1..420: note = chr9:32999936-33000356
  misc_feature 1..420: note = Hypo
  source 1..420: mol_type = genomic DNA

SEQ ID NO: 130545 - DNA, 33 bp, Homo sapiens; identical to SEQ ID NO: 101040
  misc_feature 1..33: note = chr9:33077261-33077294
  misc_feature 1..33: note = Hypo
  source 1..33: mol_type = genomic DNA

SEQ ID NO: 130546 - DNA, 30 bp, Homo sapiens; identical to SEQ ID NO: 101041
  misc_feature 1..30: note = chr9:33136558-33136588
  misc_feature 1..30: note = Hypo
  source 1..30: mol_type = genomic DNA

SEQ ID NO: 130547 - DNA, 30 bp, Homo sapiens; identical to SEQ ID NO: 101042
  misc_feature 1..30: note = chr9:33306864-33306894
  misc_feature 1..30: note = Hypo
  source 1..30: mol_type = genomic DNA

SEQ ID NO: 130548 - DNA, 157 bp, Homo sapiens; identical to SEQ ID NO: 101043
  misc_feature 1..157: note = chr9:33418331-33418488
  misc_feature 1..157: note = Hypo
  source 1..157: mol_type = genomic DNA

SEQ ID NO: 130549 - DNA, 111 bp, Homo sapiens; identical to SEQ ID NO: 101044
  misc_feature 1..111: note = chr9:33440312-33440423
  misc_feature 1..111: note = Hypo
  source 1..111: mol_type = genomic DNA

SEQ ID NO: 130550 - DNA, 96 bp, Homo sapiens; identical to SEQ ID NO: 101045
  misc_feature 1..96: note = chr9:33447388-33447484
  misc_feature 1..96: note = Hyper
  source 1..96: mol_type = genomic DNA

SEQ ID NO: 130551 - DNA, 58 bp, Homo sapiens; identical to SEQ ID NO: 101046
  misc_feature 1..58: note = chr9:33511134-33511192
  misc_feature 1..58: note = Hyper
  source 1..58: mol_type = genomic DNA

SEQ ID NO: 130552 - DNA, 300 bp, Homo sapiens; identical to SEQ ID NO: 101047
  misc_feature 1..300: note = chr9:33523978-33524278
  misc_feature 1..300: note = Hyper
  source 1..300: mol_type = genomic DNA

SEQ ID NO: 130553 - DNA, 503 bp, Homo sapiens; identical to SEQ ID NO: 101048
  misc_feature 1..503: note = chr9:33524338-33524841
  misc_feature 1..503: note = Hyper
  source 1..503: mol_type = genomic DNA

SEQ ID NO: 130554 - DNA, 24 bp, Homo sapiens
  misc_feature 1..24: note = chr9:33647199-33647223
  misc_feature 1..24: note = Hypo
  source 1..24: mol_type = genomic DNA
gcgagactgcgtctcaaaaaaaaa

SEQ ID NO: 130555 - DNA, 692 bp, Homo sapiens; identical to SEQ ID NO: 101050
  misc_feature 1..692: note = chr9:33676745-33677437
  misc_feature 1..692: note = Hyper
  source 1..692: mol_type = genomic DNA

SEQ ID NO: 130556 - DNA, 30 bp, Homo sapiens; identical to SEQ ID NO: 42114
  misc_feature 1..30: note = chr9:33862299-33862329
  misc_feature 1..30: note = Hypo
  source 1..30: mol_type = genomic DNA

SEQ ID NO: 130557 - DNA, 28 bp, Homo sapiens
  misc_feature 1..28: note = chr9:34036390-34036418
  misc_feature 1..28: note = Hypo
  source 1..28: mol_type = genomic DNA
aggcgtgagccaccgtgcccagccttga

SEQ ID NO: 130558 - DNA, 36 bp, Homo sapiens; identical to SEQ ID NO: 101053
  misc_feature 1..36: note = chr9:34046353-34046389
  misc_feature 1..36: note = Hypo
  source 1..36: mol_type = genomic DNA

SEQ ID NO: 130559 - DNA, 39 bp, Homo sapiens; identical to SEQ ID NO: 42116
  misc_feature 1..39: note = chr9:34062515-34062554
  misc_feature 1..39: note = Hypo
  source 1..39: mol_type = genomic DNA

SEQ ID NO: 130560 - DNA, 99 bp, Homo sapiens; identical to SEQ ID NO: 42117
  misc_feature 1..99: note = chr9:34063196-34063295
  misc_feature 1..99: note = Hypo
  source 1..99: mol_type = genomic DNA

SEQ ID NO: 130561 - DNA, 57 bp, Homo sapiens; identical to SEQ ID NO: 42118
  misc_feature 1..57: note = chr9:34224348-34224405
  misc_feature 1..57: note = Hypo
  source 1..57: mol_type = genomic DNA

SEQ ID NO: 130562 - DNA, 30 bp, Homo sapiens; identical to SEQ ID NO: 101057
  misc_feature 1..30: note = chr9:34279911-34279941
  misc_feature 1..30: note = Hypo
  source 1..30: mol_type = genomic DNA

SEQ ID NO: 130563 - DNA, 71 bp, Homo sapiens; identical to SEQ ID NO: 101058
  misc_feature 1..71: note = chr9:34372844-34372915
  misc_feature 1..71: note = Hypo
  source 1..71: mol_type = genomic DNA

SEQ ID NO: 130564 - DNA, 139 bp, Homo sapiens; identical to SEQ ID NO: 101059
  misc_feature 1..139: note = chr9:34381074-34381213
  misc_feature 1..139: note = Hyper
  source 1..139: mol_type = genomic DNA

SEQ ID NO: 130565 - DNA, 30 bp, Homo sapiens; identical to SEQ ID NO: 101060
  misc_feature 1..30: note = chr9:34494080-34494110
  misc_feature 1..30: note = Hyper
  source 1..30: mol_type = genomic DNA

SEQ ID NO: 130566 - DNA, 56 bp, Homo sapiens; identical to SEQ ID NO: 42119
  misc_feature 1..56: note = chr9:34574808-34574864
  misc_feature 1..56: note = Hypo
  source 1..56: mol_type = genomic DNA

SEQ ID NO: 130567 - DNA, 30 bp, Homo sapiens; identical to SEQ ID NO: 101062
  misc_feature 1..30: note = chr9:34577915-34577945
  misc_feature 1..30: note = Hyper
  source 1..30: mol_type = genomic DNA

SEQ ID NO: 130568 - DNA, 603 bp, Homo sapiens; identical to SEQ ID NO: 101063
  misc_feature 1..603: note = chr9:34588995-34589598
  misc_feature 1..603: note = Hyper
  source 1..603: mol_type = genomic DNA

SEQ ID NO: 130569 - DNA, 356 bp, Homo sapiens; identical to SEQ ID NO: 101064
  misc_feature 1..356: note = chr9:34589889-34590245
  misc_feature 1..356: note = Hyper
  source 1..356: mol_type = genomic DNA

SEQ ID NO: 130570 - DNA, 201 bp, Homo sapiens; identical to SEQ ID NO: 101065
  misc_feature 1..201: note = chr9:34591455-34591656
  misc_feature 1..201: note = Hyper
  source 1..201: mol_type = genomic DNA

SEQ ID NO: 130571 - DNA, 168 bp, Homo sapiens; identical to SEQ ID NO: 101066
  misc_feature 1..168: note = chr9:34665047-34665215
  misc_feature 1..168: note = Hyper
  source 1..168: mol_type = genomic DNA

SEQ ID NO: 130572 - DNA, 57 bp, Homo sapiens; identical to SEQ ID NO: 101067
  misc_feature 1..57: note = chr9:34666056-34666113
  misc_feature 1..57: note = Hyper
  source 1..57: mol_type = genomic DNA

SEQ ID NO: 130573 - DNA, 395 bp, Homo sapiens; identical to SEQ ID NO: 101068
  misc_feature 1..395: note = chr9:34701358-34701753
  misc_feature 1..395: note = Hyper
  source 1..395: mol_type = genomic DNA

SEQ ID NO: 130574 - DNA, 42 bp, Homo sapiens; identical to SEQ ID NO: 101069
  misc_feature 1..42: note = chr9:34702295-34702337
  misc_feature 1..42: note = Hyper
  source 1..42: mol_type = genomic DNA

SEQ ID NO: 130575 - DNA, 44 bp, Homo sapiens; identical to SEQ ID NO: 101070
  misc_feature 1..44: note = chr9:34760663-34760707
  misc_feature 1..44: note = Hyper
  source 1..44: mol_type = genomic DNA

SEQ ID NO: 130576 - DNA, 480 bp, Homo sapiens
  misc_feature 1..480: note = chr9:34809575-34810055
  misc_feature 1..480: note = Hyper
  source 1..480: mol_type = genomic DNA
actgcagagagtgtccgaatgccagcgtcgtgagcctggaggcctagggtgggcagcttggcgagagagcacgagggcgaaagtcgctggaagagtcattctcacccttacgggcaggagcggaacaaagtgttagcggcctcagccctgcgccccctccgggcggacactgttcttgctgcagttggccggctgtttcagtccccgcgccgcagtccagggcgctcgtagagggcgccaactggcacctgggcccactactcatccgagcccatggaaccccacttccgcgtccccccaccgtaagcacgccggtgcccctagctgattcgggaggccagtacctcggggcgcgggggcgcggggcggaacgcagcgcgcgcccacctgccggccaagaaagcctcgcgtgggcgcacgcgccgccgccgcccacgcgccgccgccgccgcccacgcctcaactcggcagctcagccag

SEQ ID NO: 130577 - DNA, 252 bp, Homo sapiens; identical to SEQ ID NO: 101071
  misc_feature 1..252: note = chr9:34957876-34958128
  misc_feature 1..252: note = Hyper
  source 1..252: mol_type = genomic DNA

SEQ ID NO: 130578 - DNA, 124 bp, Homo sapiens; identical to SEQ ID NO: 101072
  misc_feature 1..124: note = chr9:34971432-34971556
  misc_feature 1..124: note = Hypo
  source 1..124: mol_type = genomic DNA

SEQ ID NO: 130579 - DNA, 38 bp, Homo sapiens; identical to SEQ ID NO: 101073
  misc_feature 1..38: note = chr9:35060862-35060900
  misc_feature 1..38: note = Hypo
  source 1..38: mol_type = genomic DNA

SEQ ID NO: 130580 - DNA, 369 bp, Homo sapiens; identical to SEQ ID NO: 101074
  misc_feature 1..369: note = chr9:35162053-35162422
  misc_feature 1..369: note = Hyper
  source 1..369: mol_type = genomic DNA

SEQ ID NO: 130581 - DNA, 443 bp, Homo sapiens; identical to SEQ ID NO: 101076
  misc_feature 1..443: note = chr9:35616922-35617365
  misc_feature 1..443: note = Hyper
  source 1..443: mol_type = genomic DNA

SEQ ID NO: 130582 - DNA, 637 bp, Homo sapiens
  misc_feature 1..637: note = chr9:35675494-35676131
  misc_feature 1..637: note = Hyper
  source 1..637: mol_type = genomic DNA
ggctctaagcttgagcggttcatccttttcatttatacaggggatgaccagagtcattggcgctatggaggtgagacacccacccgctgcacagacccaatctgggaacccagctctgtggatctcccctacagccgtccctgaacactggtcccgggcgtcccacccgccgcccaccgtcccaccccctcaccttttctacccgggttccctaagttcctgacctaggcgtcagacttcctcactatactctcccaccccaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtggtgagggggtctccccgccgagacttggggatggggcggggcgcagggaagggaaccgtcgcggcagtgcctgcccgggggttgggctggccctaccgggcggggccggctcacttgcctctccctacgcagtgcaactgaccctgcctcctgggctagagatggctctgggtcccgggcgggagtaccgggctctgcagctg

SEQ ID NO: 130583 - DNA, 30 bp, Homo sapiens; identical to SEQ ID NO: 42120
  misc_feature 1..30: note = chr9:35696547-35696577
  misc_feature 1..30: note = Hypo
  source 1..30: mol_type = genomic DNA

SEQ ID NO: 130584 - DNA, 30 bp, Homo sapiens; identical to SEQ ID NO: 101080
  misc_feature 1..30: note = chr9:35712225-35712255
  misc_feature 1..30: note = Hypo
  source 1..30: mol_type = genomic DNA

SEQ ID NO: 130585 - DNA, 65 bp, Homo sapiens; identical to SEQ ID NO: 9890
  misc_feature 1..65: note = chr9:35728859-35728924
  misc_feature 1..65: note = Hyper
  source 1..65: mol_type = genomic DNA

SEQ ID NO: 130586 - DNA, 95 bp, Homo sapiens; identical to SEQ ID NO: 42121
  misc_feature 1..95: note = chr9:35816242-35816337
  misc_feature 1..95: note = Hypo
  source 1..95: mol_type = genomic DNA

SEQ ID NO: 130587 - DNA, 22 bp, Homo sapiens
  misc_feature 1..22: note = chr9:36036080-36036102
  misc_feature 1..22: note = Hypo
  source 1..22: mol_type = genomic DNA
aggcacagtggctcacgcctgc

SEQ ID NO: 130588 - DNA, 850 bp, Homo sapiens; identical to SEQ ID NO: 101084
  misc_feature 1..850: note = chr9:36036783-36037633
  misc_feature 1..850: note = Hyper
  source 1..850: mol_type = genomic DNA

SEQ ID NO: 130589 - DNA, 30 bp, Homo sapiens; identical to SEQ ID NO: 101086
  misc_feature 1..30: note = chr9:36138930-36138960
  misc_feature 1..30: note = Hypo
  source 1..30: mol_type = genomic DNA

SEQ ID NO: 130590 - DNA, 30 bp, Homo sapiens; identical to SEQ ID NO: 101087
  misc_feature 1..30: note = chr9:36162445-36162475
  misc_feature 1..30: note = Hypo
  source 1..30: mol_type = genomic DNA

SEQ ID NO: 130591 - DNA, 30 bp, Homo sapiens; identical to SEQ ID NO: 101088
  misc_feature 1..30: note = chr9:36162711-36162741
  misc_feature 1..30: note = Hypo
  source 1..30: mol_type = genomic DNA

SEQ ID NO: 130592 - DNA, 108 bp, Homo sapiens; identical to SEQ ID NO: 101089
  misc_feature 1..108: note = chr9:36166287-36166395
  misc_feature 1..108: note = Hyper
  source 1..108: mol_type = genomic DNA

SEQ ID NO: 130593 - DNA, 28 bp, Homo sapiens
  misc_feature 1..28: note = chr9:36194299-36194327
  misc_feature 1..28: note = Hypo
  source 1..28: mol_type = genomic DNA
aggtgtgaaccaccgcacccggtgacaa

SEQ ID NO: 130594 - DNA, 99 bp, Homo sapiens; identical to SEQ ID NO: 101091
  misc_feature 1..99: note = chr9:36257346-36257445
  misc_feature 1..99: note = Hypo
  source 1..99: mol_type = genomic DNA

SEQ ID NO: 130595 - DNA, 1163 bp, Homo sapiens
  misc_feature 1..1163: note = chr9:36257855-36259018
  misc_feature 1..1163: note = Hyper
  source 1..1163: mol_type = genomic DNA
aacgtttctcaaatatacaaggaagcccagactcagaatgtagactcagagcagggaggggaccttttagcccagccttttcacgccaggacagctcgcctgccaggcagttctccaccctctctcgccccgccccgctcctaacgggacagtcagcatcccccctgattggacagcactgttccaggggacaagtcaacctgggcctccctctacatcccctcccctgctcatcagggcccaccccgagccacacggcggagccctgaattgggccaaagaggtgccctatggtgaggcctgcaggacattgggcgagagccgggtccagtgtgggcctcggggcgcggtggggtggaaagcggccggggaggggaggcctggggcaggaggccgggggaggcggccctgggggtgggcaggatgctctcccggagtcccacgccgccgcgcggctctcaccagacgccgtcagaggctccctcccacgccgccaccgcgctcctcgggcgagggacgaaccaagcgccacgaagcaggcagagcgcgagcctgcccctcggtttccgcgctcgggcgcgcgggtagacgactcgtcgctcgaccttgtccccactcctcgctcgcccagccacgcccacccggagtgccgaatccgcgatcgcgccctgacgccacccgagagagctcgcgtgattggctgctcccgtccccgtcccccaccttcccggcggtattttgaggcgcaggcagggtgctgaccagcggaccatcttccatggcctctgccgcgctggagctgctgcggggctgtcctgccagcttgtgctcccgccccgaagcgtcctcctccactggcgacacacgcactgaagcccgagtcttcccgctgggtagttgttttggtcttgcacccaaggagggatttcttgcgcctcttgttccctcagttatttcataaaccaggaccgcaactatactgtcgtgtagcgcggccaccccacagcggtccctgacgttaacccttgccgtgactgctagaagacactggtggagtgtgaattgatgaccaaggcatggcagagcctctctcatctttataatcagttcagcggcggcctccactacagggaactcccagccagtcccgaggcctagggaca

SEQ ID NO: 130596 - DNA, 24 bp, Homo sapiens
  misc_feature 1..24: note = chr9:36274726-36274750
  misc_feature 1..24: note = Hypo
  source 1..24: mol_type = genomic DNA
ttttttctcttgagacggagtctc

SEQ ID NO: 130597 - DNA, 22 bp, Homo sapiens
  misc_feature 1..22: note = chr9:36318367-36318389
  misc_feature 1..22: note = Hypo
  source 1..22: mol_type = genomic DNA
aggaagaaaaagttccgttggg

SEQ ID NO: 130598 - DNA, 582 bp, Homo sapiens
  misc_feature 1..582: note = chr9:36739447-36740029
  misc_feature 1..582: note = Hyper
  source 1..582: mol_type = genomic DNA
tctcttgcgctacagcgaatccaagaaaataattaaagctttaatttatttatacgtcttctctatagatattatagatctcacaatcgccgcctcctaatttatgcacgcagagcctgcggcagctcggagccgccagggttggggggtccgggcccctcggagcgggacggctgtcagcccccgcggtggccgcacaaaggctggggtcccggcgggcgcacctgggtgatgggcacctcccgagactccccgggacggaggcctgacagcgcgcggcggccgccttaatagactgcgggatgttctccgggagaaggctgcgccggtccccgaggacagatcatcaggcagagtggtccccggagcaggatttattagcagacaggatggggaagttgattagcctccgcggctgaacggacatcctgtcagacaggcctcttaatccaatcacttacctgtggaggggagccggctgcctcctcctggcccccttcctcctcccatggcacctgcggggccacgcggggtgctccggagccagggtacacaggccaggccttccgtgcctggcctcgc

SEQ ID NO: 130599 - DNA, 123 bp, Homo sapiens; identical to SEQ ID NO: 101098
  misc_feature 1..123: note = chr9:36748460-36748583
  misc_feature 1..123: note = Hyper
  source 1..123: mol_type = genomic DNA

SEQ ID NO: 130600 - DNA, 631 bp, Homo sapiens
  misc_feature 1..631: note = chr9:37002482-37003113
  misc_feature 1..631: note = Hyper
  source 1..631: mol_type = genomic DNA
cctttcccgtgttcacgaaaaggacagcgtgcgggccgggggactcgctcctctgcaggtaaggggggtgttcgcgggcacctctgctgccacccgcgaccgagcgccggaaacagaccccgtggagcgcatccccgacggggctgcgcgggcctctcttaccttcgtctctcttgcgcttgttggtgtcggcgctgggggacgtgatgcccaggatgccgctgatggagtacgacgagccggccgaatccgtgctcaccgaggacacctgcgtcacggagccagtggacactgcgcggagaaagacgggcggtcagggccgcagagggctgagggcggcggaccggctgtcaccgcacgtgaggctgggggcggctgggagggagcgagcgcagggtgggcagggggcgctgaggaccctcgctctgcggaggcggccacacctgagccacgagcgcaggcctcgggcgggccgtgtgccccagttctctgcgatggggggagaaagggaagggtgggcactgagaaggactgacccctgcagaaaggaacacggggacacggggacaggaagggctttcgcttaaattccagcctatccatggatgcaggaagcaggggatggagagga

SEQ ID NO: 130601 - DNA, 31 bp, Homo sapiens; identical to SEQ ID NO: 101101
  misc_feature 1..31: note = chr9:37003173-37003204
  misc_feature 1..31: note = Hyper
  source 1..31: mol_type = genomic DNA

SEQ ID NO: 130602 - DNA, 2760 bp, Homo sapiens
  misc_feature 1..2760: note = chr9:37025306-37028066
  misc_feature 1..2760: note = Hyper
  source 1..2760: mol_type = genomic DNA
agacacggacatgctcgccccgggaagctcaccttcactccagccgggtctctgctgcctttgttaaataggggacctgcggctaggaaagctggatcccaggctgttgggatgggggggagcggggtgggaggaccaggcatggggacggctcctagcccgggagcaactccctgacctgaagcccgcagagaccccgagcggcacccgagccgaggctgccgaagcctgtcaccttcctccagcctggctctgcagcaaacagaaaggaaacgcgattcgttccacttggaatttccttgaaatctccgaatctaatccggcgttaactcaccgtgagaggagcgctcatctcacaggaggctgtggtaatgggtgaattggcaggatccctgcgggccaggcagccaggccggccttgccctcgccctaaatgacccttcccgtctcctacacacgctgcgtctttcagaggcgggggtgcctgcgtggtaactaattggcttcctctttctttctttctttttcgtttcttatcctctttttttaaaggggagaagccatgagaaaaggcgtcctgcagagaaggacccaatggggtctttaagggtctctgtatgaactggccggctcctaagcagaagctgaactcagaaaccgctacttccttgatttttcaaagccccctcctcaactccaggacgcctttggagccctagccccggtgtcctcgcttagctctcaacctcttcctccacacatacagacacgggtcagggccccactatccctccaagcgccagtctggatcagccccatggctgaaaaaggcgccatcggagtaggggtgtggggcgctgtctgagactctgactggcctctccctacaacttactgccctccaactggcctggcccggagccctctacgggtccaagccagggttctccgaaagagctgaaatgtcgccgccggagccttgaaaggctgcagctcgctgcccaagctacgcgttgccggaggcgggattcccaggtgcctcagcccgggcggccaagtgcgttgtttcaggtcccctgcctgggatccctgcactttgcaaagttagctgcgcggctgcagaggtccgagatccttccggccttagtacctgacccacggtccggcacccccaacccggtcccggcgggagagtgagagaagcgagctcgccgcctacttactatgcatggatgcaaacgggtcgtgcttacagtgtatttccatcggggcgctccagactgcaggccggcccacgccgccgcctcccggcgccaaggggctgcccagggcggatagggagcctcgccaccaggccaggcactgtgcgagctgggctcagaaaacactgctggagcttcggggtctctctcagagcctccctgctggagaccgcccggagctgcgcggagaggcgggaaatggtgctagcgcacccgggctaggagcgggtgcccaactccggctggcttccctccctggctggctcaagcagcagctccgggcccagcccggggtagctgcggccaaggcgcccgcggcttcgggggcatagcgtaggggcccgcctccgggacagccagcagcccccggccccaggaaggagcagctttgaggaggccgccggaacaatcggcccttgacttcactcagggggcggagagacccgggggctgccaggctggttccgcggcctcgatgcttctgaggtccctcctcgacccctcggtctccgccagatcctttctttctctgcttctccgagtctctggggctcggacttgccccctccgcctctctccaactggctctccgacgtctcggacgaagttgcaaagaacttcctctccggcagcgcggggtcctggcgggtttggagatgcttccgcccctgacgctggggccgcgactccggagtccccgggagcgtgcagccctccaacactgagacccgctgccttcaaagttcccgcggcccccgctgctcgcccatcgctgggaccaggaacggggacaccagcgacggactcttcctcgccggggtgtctacctcgtgccaaccaactcttcgagccccgccgccctccctcgtgggtctgattccactgtctttccgctgcctcttccgggacggccgccgtgcctgccccaggcgtggagtgaggaacagaggagagagcagagggtcccagccaccaaggccgccggggctgccggggctgagatggagccgcagtcggctctgactgcctgcgttgccgccgccgccgccgtcgctagccctccgcctgctcggcgcgcacagtgcgccaccgcgccgccccggagccgctttcaggacccgctgcgtgtggacagcgccgcccggggctcagctccctccgggcgggggcggggcgggggctaacctgccaatcacgctccaccaagccaatcagagtggcgtcagccggccctggcccgaaacaccgccccattggctaagcagcccacaggctccgcctgattagcggacacctgggcaatgggagagaatggggggcggggcccaggcggcggcgccacgttcattgacaaacgcgctggactaaggcctagtggatcgcggctgtggggaggggaaaggggcccacgcagtgcctggagagtcccgctgcgggtcccacgcgggctggacctccccacagcgatgctgggatcctgggacgctctcaaggcttg

SEQ ID NO: 130603 - DNA, 40 bp, Homo sapiens; identical to SEQ ID NO: 32465
  misc_feature 1..40: note = chr9:37028470-37028510
  misc_feature 1..40: note = Hyper
  source 1..40: mol_type = genomic DNA

SEQ ID NO: 130604 - DNA, 30 bp, Homo sapiens; identical to SEQ ID NO: 32466
  misc_feature 1..30: note = chr9:37028944-37028974
  misc_feature 1..30: note = Hyper
  source 1..30: mol_type = genomic DNA

SEQ ID NO: 130605 - DNA, 1442 bp, Homo sapiens; identical to SEQ ID NO: 101108
  misc_feature 1..1442: note = chr9:37029348-37030790
  misc_feature 1..1442: note = Hyper
  source 1..1442: mol_type = genomic DNA

SEQ ID NO: 130606 - DNA, 750 bp, Homo sapiens; identical to SEQ ID NO: 32469
  misc_feature 1..750: note = chr9:37034197-37034947
  misc_feature 1..750: note = Hyper
  source 1..750: mol_type = genomic DNA

SEQ ID NO: 130607 - DNA, 380 bp, Homo sapiens; identical to SEQ ID NO: 101110
  misc_feature 1..380: note = chr9:37035506-37035886
  misc_feature 1..380: note = Hyper
  source 1..380: mol_type = genomic DNA

SEQ ID NO: 130608 - DNA, 2227 bp, Homo sapiens; identical to SEQ ID NO: 101111
  misc_feature 1..2227: note = chr9:37036127-37038354
  misc_feature 1..2227: note = Hyper
  source 1..2227: mol_type = genomic DNA

SEQ ID NO: 130609 - DNA, 215 bp, Homo sapiens; identical to SEQ ID NO: 101112
  misc_feature 1..215: note = chr9:37121892-37122107
  misc_feature 1..215: note = Hypo
  source 1..215: mol_type = genomic DNA

SEQ ID NO: 130610 - DNA, 30 bp, Homo sapiens; identical to SEQ ID NO: 42125
  misc_feature 1..30: note = chr9:37134066-37134096
  misc_feature 1..30: note = Hypo
  source 1..30: mol_type = genomic DNA

SEQ ID NO: 130611 - DNA, 30 bp, Homo sapiens; identical to SEQ ID NO: 5089
  misc_feature 1..30: note = chr9:37467610-37467640
  misc_feature 1..30: note = Hypo
  source 1..30: mol_type = genomic DNA

SEQ ID NO: 130612 - DNA, 30 bp, Homo sapiens; identical to SEQ ID NO: 5090
  misc_feature 1..30: note = chr9:37467940-37467970
  misc_feature 1..30: note = Hypo
  source 1..30: mol_type = genomic DNA

SEQ ID NO: 130613 - DNA, 41 bp, Homo sapiens; identical to SEQ ID NO: 101116
  misc_feature 1..41: note = chr9:37477115-37477156
  misc_feature 1..41: note = Hypo
  source 1..41: mol_type = genomic DNA

SEQ ID NO: 130614 - DNA, 291 bp, Homo sapiens; identical to SEQ ID NO: 101117
  misc_feature 1..291: note = chr9:37576058-37576349
  misc_feature 1..291: note = Hyper
  source 1..291: mol_type = genomic DNA

SEQ ID NO: 130615 - DNA, 38 bp, Homo sapiens; identical to SEQ ID NO: 101118
  misc_feature 1..38: note = chr9:37651342-37651380
  misc_feature 1..38: note = Hyper
  source 1..38: mol_type = genomic DNA

SEQ ID NO: 130616 - DNA, 30 bp, Homo sapiens; identical to SEQ ID NO: 101120
  misc_feature 1..30: note = chr9:37965461-37965491
  misc_feature 1..30: note = Hypo
  source 1..30: mol_type = genomic DNA

SEQ ID NO: 130617 - DNA, 30 bp, Homo sapiens; identical to SEQ ID NO: 101121
  misc_feature 1..30: note = chr9:38067678-38067708
  misc_feature 1..30: note = Hyper
  source 1..30: mol_type = genomic DNA

SEQ ID NO: 130618 - DNA, 37 bp, Homo sapiens; identical to SEQ ID NO: 101122
  misc_feature 1..37: note = chr9:38068121-38068158
  misc_feature 1..37: note = Hyper
  source 1..37: mol_type = genomic DNA

SEQ ID NO: 130619 - DNA, 161 bp, Homo sapiens; identical to SEQ ID NO: 101123
  misc_feature 1..161: note = chr9:38189469-38189630
  misc_feature 1..161: note = Hypo
  source 1..161: mol_type = genomic DNA

SEQ ID NO: 130620 - DNA, 436 bp, Homo sapiens; identical to SEQ ID NO: 101124
  misc_feature 1..436: note = chr9:38424302-38424738
  misc_feature 1..436: note = Hyper
  source 1..436: mol_type = genomic DNA

SEQ ID NO: 130621 - DNA, 350 bp, Homo sapiens; identical to SEQ ID NO: 101125
  misc_feature 1..350: note = chr9:38620053-38620403
  misc_feature 1..350: note = Hyper
  source 1..350: mol_type = genomic DNA

SEQ ID NO: 130622 - DNA, 86 bp, Homo sapiens; identical to SEQ ID NO: 101126
  misc_feature 1..86: note = chr9:38620735-38620821
  misc_feature 1..86: note = Hyper
  source 1..86: mol_type = genomic DNA

SEQ ID NO: 130623 - DNA, 360 bp, Homo sapiens; identical to SEQ ID NO: 101127
  misc_feature 1..360: note = chr9:38620881-38621241
  misc_feature 1..360: note = Hyper
  source 1..360: mol_type = genomic DNA

SEQ ID NO: 130624 - DNA, 565 bp, Homo sapiens; identical to SEQ ID NO: 101128
  misc_feature 1..565: note = chr9:38621421-38621986
  misc_feature 1..565: note = Hyper
  source 1..565: mol_type = genomic DNA

SEQ ID NO: 130625 - DNA, 85 bp, Homo sapiens; identical to SEQ ID NO: 101129
  misc_feature 1..85: note = chr9:38622559-38622644
  misc_feature 1..85: note = Hyper
  source 1..85: mol_type = genomic DNA

SEQ ID NO: 130626 - DNA, 31 bp, Homo sapiens; identical to SEQ ID NO: 42128
  misc_feature 1..31: note = chr9:38646913-38646944
  misc_feature 1..31: note = Hypo
  source 1..31: mol_type = genomic DNA

SEQ ID NO: 130627 - DNA, 121 bp, Homo sapiens; identical to SEQ ID NO: 101131
  misc_feature 1..121: note = chr9:40633719-40633840
  misc_feature 1..121: note = Hyper
  source 1..121: mol_type = genomic DNA

SEQ ID NO: 130628 - DNA, 23 bp, Homo sapiens
  misc_feature 1..23: note = chr9:41242566-41242589
  misc_feature 1..23: note = Hypo
  source 1..23: mol_type = genomic DNA
aagaatgaatatggccggtcttg

SEQ ID NO: 130629 - DNA, 129 bp, Homo sapiens; identical to SEQ ID NO: 101136
  misc_feature 1..129: note = chr9:43684951-43685080
  misc_feature 1..129: note = Hyper
  source 1..129: mol_type = genomic DNA

SEQ ID NO: 130630 - DNA, 24 bp, Homo sapiens
  misc_feature 1..24: note = chr9:45356983-45357007
  misc_feature 1..24: note = Hyper
  source 1..24: mol_type = genomic DNA
gcgtgcgctcgaggcctgagggac

SEQ ID NO: 130631 - DNA, 41 bp, Homo sapiens; identical to SEQ ID NO: 101138
  misc_feature 1..41: note = chr9:45371461-45371502
  misc_feature 1..41: note = Hypo
  source 1..41: mol_type = genomic DNA

SEQ ID NO: 130632 - DNA, 152 bp, Homo sapiens; identical to SEQ ID NO: 101148
  misc_feature 1..152: note = chr9:66455725-66455877
  misc_feature 1..152: note = Hyper
  source 1..152: mol_type = genomic DNA

SEQ ID NO: 130633 - DNA, 32 bp, Homo sapiens; identical to SEQ ID NO: 101149
  misc_feature 1..32: note = chr9:66455997-66456029
  misc_feature 1..32: note = Hyper
  source 1..32: mol_type = genomic DNA

SEQ ID NO: 130634 - DNA, 300 bp, Homo sapiens; identical to SEQ ID NO: 101150
  misc_feature 1..300: note = chr9:66458292-66458592
  misc_feature 1..300: note = Hyper
  source 1..300: mol_type = genomic DNA

SEQ ID NO: 130635 - DNA, 180 bp, Homo sapiens; identical to SEQ ID NO: 101151
  misc_feature 1..180: note = chr9:66494095-66494275
  misc_feature 1..180: note = Hyper
  source 1..180: mol_type = genomic DNA

SEQ ID NO: 130636 - DNA, 127 bp, Homo sapiens; identical to SEQ ID NO: 101155
  misc_feature 1..127: note = chr9:69197629-69197756
  misc_feature 1..127: note = Hyper
  source 1..127: mol_type = genomic DNA

SEQ ID NO: 130637 - DNA, 30 bp, Homo sapiens; identical to SEQ ID NO: 101156
  misc_feature 1..30: note = chr9:70652569-70652599
  misc_feature 1..30: note = Hypo
  source 1..30: mol_type = genomic DNA

SEQ ID NO: 130638 - DNA, 120 bp, Homo sapiens; identical to SEQ ID NO: 101157
  misc_feature 1..120: note = chr9:71200600-71200720
  misc_feature 1..120: note = Hypo
  source 1..120: mol_type = genomic DNA

SEQ ID NO: 130639 - DNA, 176 bp, Homo sapiens; identical to SEQ ID NO: 101158
  misc_feature 1..176: note = chr9:71223791-71223967
  misc_feature 1..176: note = Hypo
  source 1..176: mol_type = genomic DNA

SEQ ID NO: 130640 - DNA, 29 bp, Homo sapiens
  misc_feature 1..29: note = chr9:71369369-71369398
  misc_feature 1..29: note = Hypo
  source 1..29: mol_type = genomic DNA
ccaccacgcccggccggttccatgatttt

SEQ ID NO: 130641 - DNA, 106 bp, Homo sapiens; identical to SEQ ID NO: 42130
  misc_feature 1..106: note = chr9:71425241-71425347
  misc_feature 1..106: note = Hypo
  source 1..106: mol_type = genomic DNA

SEQ ID NO: 130642 - DNA, 27 bp, Homo sapiens
  misc_feature 1..27: note = chr9:71500809-71500836
  misc_feature 1..27: note = Hypo
  source 1..27: mol_type = genomic DNA
aaatttggccaggtgcggtggctcacg

SEQ ID NO: 130643 - DNA, 27 bp, Homo sapiens
  misc_feature 1..27: note = chr9:71501076-71501103
  misc_feature 1..27: note = Hypo
  source 1..27: mol_type = genomic DNA
agagcgagactccgtctgaaaaaaaaa

SEQ ID NO: 130644 - DNA, 35 bp, Homo sapiens; identical to SEQ ID NO: 101163
  misc_feature 1..35: note = chr9:71576130-71576165
  misc_feature 1..35: note = Hypo
  source 1..35: mol_type = genomic DNA

SEQ ID NO: 130645 - DNA, 82 bp, Homo sapiens; identical to SEQ ID NO: 101164
  misc_feature 1..82: note = chr9:71583902-71583984
  misc_feature 1..82: note = Hypo
  source 1..82: mol_type = genomic DNA

SEQ ID NO: 130646 - DNA, 18 bp, Homo sapiens
  misc_feature 1..18: note = chr9:71655284-71655302
  misc_feature 1..18: note = Hypo
  source 1..18: mol_type = genomic DNA
atgtaaatatttatacgc

SEQ ID NO: 130647 - DNA, 30 bp, Homo sapiens; identical to SEQ ID NO: 101167
  misc_feature 1..30: note = chr9:71704692-71704722
  misc_feature 1..30: note = Hypo
  source 1..30: mol_type = genomic DNA

SEQ ID NO: 130648 - DNA, 120 bp, Homo sapiens; identical to SEQ ID NO: 42133
  misc_feature 1..120: note = chr9:71734802-71734922
  misc_feature 1..120: note = Hypo
  source 1..120: mol_type = genomic DNA

SEQ ID NO: 130649 - DNA, 19 bp, Homo sapiens
  misc_feature 1..19: note = chr9:71738790-71738809
  misc_feature 1..19: note = Hypo
  source 1..19: mol_type = genomic DNA
ttatttattttgagacgga

SEQ ID NO: 130650 - DNA, 463 bp, Homo sapiens
  misc_feature 1..463: note = chr9:71788950-71789413
  misc_feature 1..463: note = Hyper
  source 1..463: mol_type = genomic DNA
cccggccaggagtcgcgcgtgacgcggttcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgtaagtgcctccttgtgccgcgcggttgggaggagggtcgtgagcgtgagcgtgggagcgctggg

SEQ ID NO: 130651 - DNA, 61 bp, Homo sapiens; identical to SEQ ID NO: 32483
  misc_feature 1..61: note = chr9:71789696-71789757
  misc_feature 1..61: note = Hyper
  source 1..61: mol_type = genomic DNA

SEQ ID NO: 130652 - DNA, 27 bp, Homo sapiens
  misc_feature 1..27: note = chr9:71921187-71921214
  misc_feature 1..27: note = Hypo
  source 1..27: mol_type = genomic DNA
tctgggcaagatgatcgccctgaataa

SEQ ID NO: 130653 - DNA, 251 bp, Homo sapiens; identical to SEQ ID NO: 101173
  misc_feature 1..251: note = chr9:71939733-71939984
  misc_feature 1..251: note = Hyper
  source 1..251: mol_type = genomic DNA

SEQ ID NO: 130654 - DNA, 30 bp, Homo sapiens; identical to SEQ ID NO: 101174
  misc_feature 1..30: note = chr9:72286957-72286987
  misc_feature 1..30: note = Hyper
  source 1..30: mol_type = genomic DNA

SEQ ID NO: 130655 - DNA, 44 bp, Homo sapiens; identical to SEQ ID NO: 42135
  misc_feature 1..44: note = chr9:72819967-72820011
  misc_feature 1..44: note = Hypo
  source 1..44: mol_type = genomic DNA

SEQ ID NO: 130656 - DNA, 269 bp, Homo sapiens; identical to SEQ ID NO: 101176
  misc_feature 1..269: note = chr9:73027315-73027584
  misc_feature 1..269: note = Hyper
  source 1..269: mol_type = genomic DNA

SEQ ID NO: 130657 - DNA, 336 bp, Homo sapiens; identical to SEQ ID NO: 101177
  misc_feature 1..336: note = chr9:73027969-73028305
  misc_feature 1..336: note = Hyper
  source 1..336: mol_type = genomic DNA

SEQ ID NO: 130658 - DNA, 34 bp, Homo sapiens; identical to SEQ ID NO: 101178
  misc_feature 1..34: note = chr9:73032801-73032835
  misc_feature 1..34: note = Hypo
  source 1..34: mol_type = genomic DNA

SEQ ID NO: 130659 - DNA, 30 bp, Homo sapiens; identical to SEQ ID NO: 101180
  misc_feature 1..30: note = chr9:73438545-73438575
  misc_feature 1..30: note = Hypo
  source 1..30: mol_type = genomic DNA

SEQ ID NO: 130660 - DNA, 448 bp, Homo sapiens
  misc_feature 1..448: note = chr9:74061662-74062110
  misc_feature 1..448: note = Hyper
  source 1..448: mol_type = genomic DNA
ctccggctgcgtctgcggctctccgcgttgtcctcgcggtcggagcagccccgctccatttccgccgcatccctccacttcttccccatgagaagttcgcctccctcggccgggaaacagcccagcgccgagcgctctcgctggctcctcgccgcgggtctccctccagcctgcgcgcggctctcggttggcgctgcctttgcctccgccggctcctgccagagccccgcgctccgttaccgccgccgccaccaggctgcgcttgcgcccgcgattggctcaactgtgggctggggctgcgagcgccacctgcgcccgagccagctttcttttgcgtccccaaattgctctccacccggcagccgccgccttctctggagagtgcagggcccacgcctgaggctgttgatgcgccgcagggtagcgctcccagcggtcacctcaccct

SEQ ID NO: 130661 - DNA, 173 bp, Homo sapiens; identical to SEQ ID NO: 42137
  misc_feature 1..173: note = chr9:74469850-74470023
  misc_feature 1..173: note = Hypo
  source 1..173: mol_type = genomic DNA

SEQ ID NO: 130662 - DNA, 582 bp, Homo sapiens; identical to SEQ ID NO: 101184
  misc_feature 1..582: note = chr9:74764297-74764879
  misc_feature 1..582: note = Hyper
  source 1..582: mol_type = genomic DNA

SEQ ID NO: 130663 - DNA, 30 bp, Homo sapiens; identical to SEQ ID NO: 101185
  misc_feature 1..30: note = chr9:75545858-75545888
  misc_feature 1..30: note = Hypo
  source 1..30: mol_type = genomic DNA

SEQ ID NO: 130664 - DNA, 22 bp, Homo sapiens
  misc_feature 1..22: note = chr9:76966084-76966106
  misc_feature 1..22: note = Hypo
  source 1..22: mol_type = genomic DNA
ggcaccgcgcctggcctgcatt

SEQ ID NO: 130665 - DNA, 606 bp, Homo sapiens; identical to SEQ ID NO: 101187
  misc_feature 1..606: note = chr9:77111763-77112369
  misc_feature 1..606: note = Hyper
  source 1..606: mol_type = genomic DNA

SEQ ID NO: 130666 - DNA, 2249 bp, Homo sapiens
  misc_feature 1..2249: note = chr9:77112703-77114952
  misc_feature 1..2249: note = Hyper
  source 1..2249: mol_type = genomic DNA
ttaacatagcggcggcggcggcaaacgtcaccctgcagccacggcgtccgcctaaagggatggttttctcggcagagcagctcttcgccgaccaccttcttcactcgtgctgagcgggatttttgggctctccggggttcgggctgggagcagcttcatgactacgcggagcgggagagcggccacaccatgcgaggtaagcgagtctgcgggcaccgaggctccccgagtccggccaactccagccagacggggagatgggggaggggagggcacccagcagaaagggaaagaggttgcccaggcgcagttccccgaattcgctctcgcaggtggggctgcaaatggcctgggcgtagaaagttgcgggaaggtgttgatgtctttcgggagttctggagggacgcgggagggcgcttttttggagaggggagacaggctagttggttcttaccagtccttgagttgcactgaatcttttttgcttgtcgctctcgggtgcggaagcggacgcgggatggagaaagccgaaagagggatgcctctggacaggagcagtttggaagcgcccggcgcgcagtggtcgccggccgggtttgggcgcgcggggcgcaccggccgggggcagggtggacacgcgcgggcacacactcgccaggttacgaggcccactaagcgtcctggccagcaggcatgtcccttcgctggagtagcaagcagaagagcagtgctgcgaggctggacgcggctgaggaaacagttagttccccggcacgcggctgaggaaacagttctgcggcgcgcgccttcgtgccggcgctgcgccctggccaggtcctcgtgcccgagcccgcgcggcccagggagtagtgcgaccccggaaaagttgtaatgagaaagttctggaggcttggaaaggccacactgctcacagtcggagagtcatgggctccggctcttttgtcagataaagggccggtagtggaaggaggtgctggtgcaccctcgggccaggaccctcgcagtcgcaggcggtggcggcggcggcggcgggaccccggggcgagctggggtctgcagggatgcgcgccagggactgtagcgttacgcttgctccggctggactctgggcctctcgaagggctggagggtgggtttcggggagtcacttggtctcctctcctgccttgccggagacctcaggtttccttcgcgctgtgctcggcctttcttcactcttttactgaagagccaggcgggtgtccgcttgacatggggatctgtgcaagctctgggcacccacccccactcccagtccctcttcctggccacacagcggttaatcgggggctcttctctatccttcgcacgtacccctgggtcttgacaacagaaagttagtaacggccagctccagaccttcttgcatcccagacccggagagaggtggtctaggcagggagcacttgggagagttgggatgcaatcactggtctcctccttccactgaaagtgatcctctcccacccagtccccctacgcccctagaggagcaccccaggaggcagcgggtctcactcccactccctcccgcacccggtgagccccgagcctggactcaagggtttgctggctggacgctgggatgtgtcaggaaagggaaggagaagaaggaacggagagagactgtccatgggggagggggttgactgtagataagaaacaaggacgtcctgatgggatggtcttgattggccggctcgctgggagtggggcacccgtgtgtgtgcgcgctggctccagctgattgtcccggttgggggttggttacacgctccactgtctaaattctttcaagaaactatacttgggcaattggagagtagagaaccttggcttagtaagagacgcccggtcttttgtttttctttttctagcccatctcaccatcccatccattctttcggtttcccccgtcccagtccagagctgccagttcgtccctccccttcttcccttctaactttccccctgtggctgggttcatactttctgaacgtcgtaaactatgcgccacctcagctcggacccagcactaggacctagggcataaaatccgctcactccttacatcgtagaaggagtgcggcgcggggtggggatgggttgtagcttgatctagcatctcctgaaggagcagtttgcagatgactgtcctggttcgccacggcggtcgctttgaggactcc

SEQ ID NO: 130667 - DNA, 274 bp, Homo sapiens; identical to SEQ ID NO: 101192
  misc_feature 1..274: note = chr9:77115210-77115484
  misc_feature 1..274: note = Hyper
  source 1..274: mol_type = genomic DNA

SEQ ID NO: 130668 - DNA, 209 bp, Homo sapiens; identical to SEQ ID NO: 32495
  misc_feature 1..209: note = chr9:77502024-77502233
  misc_feature 1..209: note = Hyper
  source 1..209: mol_type = genomic DNA

SEQ ID NO: 130669 - DNA, 123 bp, Homo sapiens; identical to SEQ ID NO: 101194
  misc_feature 1..123: note = chr9:77502613-77502736
  misc_feature 1..123: note = Hyper
  source 1..123: mol_type = genomic DNA

SEQ ID NO: 130670 - DNA, 30 bp, Homo sapiens; identical to SEQ ID NO: 101195
  misc_feature 1..30: note = chr9:77802622-77802652
  misc_feature 1..30: note = Hypo
  source 1..30: mol_type = genomic DNA

SEQ ID NO: 130671 - DNA, 34 bp, Homo sapiens; identical to SEQ ID NO: 101196
  misc_feature 1..34: note = chr9:78505588-78505622
  misc_feature 1..34: note = Hyper
  source 1..34: mol_type = genomic DNA

SEQ ID NO: 130672 - DNA, 77 bp, Homo sapiens; identical to SEQ ID NO: 101197
  misc_feature 1..77: note = chr9:78506339-78506416
  misc_feature 1..77: note = Hyper
  source 1..77: mol_type = genomic DNA

SEQ ID NO: 130673 - DNA, 256 bp, Homo sapiens; identical to SEQ ID NO: 101198
  misc_feature 1..256: note = chr9:78506476-78506732
  misc_feature 1..256: note = Hyper
  source 1..256: mol_type = genomic DNA

SEQ ID NO: 130674 - DNA, 104 bp, Homo sapiens; identical to SEQ ID NO: 101199
  misc_feature 1..104: note = chr9:78507584-78507688
  misc_feature 1..104: note = Hyper
  source 1..104: mol_type = genomic DNA

SEQ ID NO: 130675 - DNA, 63 bp, Homo sapiens; identical to SEQ ID NO: 101200
  misc_feature 1..63: note = chr9:78557098-78557161
  misc_feature 1..63: note = Hypo
  source 1..63: mol_type = genomic DNA

SEQ ID NO: 130676 - DNA, 78 bp, Homo sapiens; identical to SEQ ID NO: 101201
  misc_feature 1..78: note = chr9:79073402-79073480
  misc_feature 1..78: note = Hypo
  source 1..78: mol_type = genomic DNA

SEQ ID NO: 130677 - DNA, 95 bp, Homo sapiens; identical to SEQ ID NO: 101202
  misc_feature 1..95: note = chr9:79231284-79231379
  misc_feature 1..95: note = Hypo
  source 1..95: mol_type = genomic DNA

SEQ ID NO: 130678 - DNA, 75 bp, Homo sapiens; identical to SEQ ID NO: 101203
  misc_feature 1..75: note = chr9:79409102-79409177
  misc_feature 1..75: note = Hypo
  source 1..75: mol_type = genomic DNA

SEQ ID NO: 130679 - DNA, 30 bp, Homo sapiens; identical to SEQ ID NO: 101204
  misc_feature 1..30: note = chr9:79521303-79521333
  misc_feature 1..30: note = Hyper
  source 1..30: mol_type = genomic DNA

SEQ ID NO: 130680 - DNA, 541 bp, Homo sapiens; identical to SEQ ID NO: 32498
  misc_feature 1..541: note = chr9:79626876-79627417
  misc_feature 1..541: note = Hyper
  source 1..541: mol_type = genomic DNA

SEQ ID NO: 130681 - DNA, 91 bp, Homo sapiens; identical to SEQ ID NO: 101206
  misc_feature 1..91: note = chr9:79628238-79628329
  misc_feature 1..91: note = Hyper
  source 1..91: mol_type = genomic DNA

SEQ ID NO: 130682 - DNA, 714 bp, Homo sapiens
  misc_feature 1..714: note = chr9:79628692-79629406
  misc_feature 1..714: note = Hyper
  source 1..714: mol_type = genomic DNA
ctggttgctgatgtgcggagtctttgttattagtcgtcggagggagcgcaagaaagttatttaatttttaatcgttggttatttatttggtggttatggttgtcagtggccgctacctaaacagacacggcccgtaggaaagcttctggatgttggccaagaggtgtgaggcgcgggtggactgtaaaggggaaattgctctgctagggtgacacaaacgcttcccatctccacgctgattgcgcgccccgggccacaggcagtgtacacagccgcggtgttcgagacgaatctcgcctcgaagagtggagatttaaaagtcaggtttctgactctgggcagcacgtagggtctttgcggagtgagtttcggtcagacgagagcctggggtcaatgtcgaggtggagcgacgctggcacggcaaccctgagcctgcgcggcccggcgctatcccctggctctccgctgctggctggacccccttgtatcctccttccctcaaactcgcacacctacggctcagacaacccagccagtctcgcccgcgagcggaggtgctagaaactttgggggacgaaagctgggctgtctttcttggccggtggcactgcgagagaaagccgtgtgcaccccgcggctgaccactccaacgccagatacatccacccgctcatgtaccgccgtcgggcttcattttgtcgagctcttcttagg

SEQ ID NO: 130683 - DNA, 30 bp, Homo sapiens; identical to SEQ ID NO: 101209
  misc_feature 1..30: note = chr9:79629607-79629637
  misc_feature 1..30: note = Hyper
  source 1..30: mol_type = genomic DNA

SEQ ID NO: 130684 - DNA, 587 bp, Homo sapiens; identical to SEQ ID NO: 101210
  misc_feature 1..587: note = chr9:79629850-79630437
  misc_feature 1..587: note = Hyper
  source 1..587: mol_type = genomic DNA

SEQ ID NO: 130685 - DNA, 1223 bp, Homo sapiens; identical to SEQ ID NO: 101211
  misc_feature 1..1223: note = chr9:79631016-79632239
  misc_feature 1..1223: note = Hyper
  source 1..1223: mol_type = genomic DNA

SEQ ID NO: 130686 - DNA, 98 bp, Homo sapiens; identical to SEQ ID NO: 101212
  misc_feature 1..98: note = chr9:79632823-79632921
  misc_feature 1..98: note = Hyper
  source 1..98: mol_type = genomic DNA

SEQ ID NO: 130687 - DNA, 2767 bp, Homo sapiens
  misc_feature 1..2767: note = chr9:79633212-79635979
  misc_feature 1..2767: note = Hyper
  source 1..2767: mol_type = genomic DNA
gagagaagctcacagcgagtagatgaaaacagggaagggtaaaaggaagggggcggaagagggagatgccagagagaagagaagcaagaaggcagtgtcctgttccccctccaccgtgcttggtggcccgggtggggcgcagctgcgggaaatgcacccggagctgtgccccctcccggcgaacagcctgcgccacccgccgcaccgggaggtggctgggggctgccgagcgagtggtgaacgcgatgggtggagagcgcccgaaacgaggtggaaaagggggcgggggcgaggcacggcgccttcttgccccttcttcagctacagacgcggcggcggcggctgagtccctcagcctcggtcatgtgatagtctcgaagcgctagctgcgggggtctcggcgtctcggggaccattacaaaacgcagccaggagagcgcgtcgctgccactgccgtcgcctctcctcctcaagacaagcccgggagaaaggcggcagctgcggcgcggacggctgagcctccccggccagcactcacccagcattcgcagacgccctctccagcccgccgctcgctcccagagtcctgcgccccacactcctcagcagaacctgcgggcgctgccgcttcagaaaccaccaaagttttttctcctcagcgacagcctagggctgcgcgtctcttctaaccccggcgacgctgcgagcctcggagaaaagagaggcgccctagaagccaatcttctctctccttaccctgatttttcactccaggaaaaggagaactccagcgcggtctggctaagtgcctggccaggggcctgcgtccagggcactggaagtcctgctgtcactggcctccaggacagcaggcgcaaactcagatttaaagggccagagtctctactgcccagaccttcctcccagccatcttggtctgggtttccctcggacctagaaaaagcaaagaggccgggaggaaacacggccccttgccactctcctctgcagccagctccagcactcagtctttggccacccgggggaagacgcagagaaggcggcggtaaacctggtgcactccgcccgcgactgtgcgcgccagtcggcaaccgtcggggccagaagttgccagcttccgagagctgagtaggcccgaaaggccaaggtcggagacaccaggcaattcggagaaggcaggagagagaagcagagagggcctggagggcgagagggcaaagtggcgggactggaggggccgagtgggaattagtgggggcagccaggccccaggaacggagtgcggagagattctgtggtccagtgcgggccggagggcggtggaggagccgggggcgatgccgcggccggggaagagctcgtacagcgaccaaaaaccgccctactcttacatctcgctgaccgccatggcaatccagcactcggccgagaagatgctgccgctgagcgacatctacaagttcatcatggagcgcttcccctactaccgcgagcacacacagcgctggcagaacagcctgcgccacaacctctccttcaacgactgcttcatcaagattccgcggaggcccgaccagcctggcaagggtagcttctgggcgctgcaccccgactgcggggacatgttcgagaacggcagcttcctgcggcgtcgcaagcgcttcaaggtgctgcgcgccgaccatactcacttgcacgcgggaagcaccaagagcgcgccgggcgccggtccgggagggcaccttcacccccatcaccaccaccacccccaccaccaccatcatcaccacgctgccgcacaccaccaccatcaccaccacccaccccagccgccgccgccgccgcccccgccgccgccgcacatggtacactatttccatcagcaaccgcctactgctccgcagccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctgccgccgcggccgcggcgtccacgtcaggcttcaagcacccctttgccattgagaacattattggccgggactacaagggcgtgctgcaggctggagggctgcccttggcgtccgtcatgcaccacctgggctaccccgtgcccggccagcttggcaacgtcgtcagctccgtgtggccgcacgttggcgtcatggattcggtggccgccgccgcggccgccgcagccgcagccggagtccctgtaggcccggagtatggggccttcggggtcccggtcaagtccctgtgccactcggcaagccagagcctgcctgccatgccggtgcccatcaagcccacgcctgcgctgccgcccgtgtccgcgctgcagccggggctcactgtccccgcggcttcgcagcagcctccggcgccatccaccgtgtgctccgcggccgcggcctcgcccgttgcctctctgctggagcccacagcccctacctcggccgaaagcaagggcggctccttgcactcggtgctagtgcactcctaggggacccggcgggcgtggggagaccagcggggtgagagacgccgggcccggaaccgcccaaaccacccgacggggagagggcgccctggtcaggccgggcagagctggcg

SEQ ID NO: 130688 - DNA, 363 bp, Homo sapiens; identical to SEQ ID NO: 101216
  misc_feature 1..363: note = chr9:79636190-79636553
  misc_feature 1..363: note = Hyper
  source 1..363: mol_type = genomic DNA

SEQ ID NO: 130689 - DNA, 749 bp, Homo sapiens; identical to SEQ ID NO: 101217
  misc_feature 1..749: note = chr9:79636807-79637556
  misc_feature 1..749: note = Hyper
  source 1..749: mol_type = genomic DNA

SEQ ID NO: 130690 - DNA, 628 bp, Homo sapiens
  misc_feature 1..628: note = chr9:79637616-79638244
  misc_feature 1..628: note = Hyper
  source 1..628: mol_type = genomic DNA
gctaggattacaggcgtgagccatcacgcccggccaccacctatttttaatatgtccgtttcctaattgaacttaagtccaccaccatggtagagactgaattagcaaaaacccgcaacagtgcgtttttcctgtcaccactatccgtcacctctctcccattttgaggtcctcgactaccatctaaggccaggaactcggtgtcagcggggtgggtgcccgacggcgcccccttaagtctgcggtcctggacggaggcagccgggttggcgccgggacactgccgctgccgcatcaactaggcaagcgcgcccagccaccgccgcctagaagacctgttgcgcgccgacaccgcgcctcgcgggaggccacagcctggggcctgggaccgcagagttcttggtgggtgaaagccggcggccaagctgctcgagctgcgggaagggaacccttgggcagcggctgctgcagagctgctctgggagtgggccaggaggccccggcagggtgcggcgcctccgctggggcctgggaagccgcgtcccggcctccgccctccaccctttagcacaggtctactttgaaccagcttccgtgtgcccagccaggccaacgaaagtcacctctg

SEQ ID NO: 130691 - DNA, 223 bp, Homo sapiens; identical to SEQ ID NO: 101220
  misc_feature 1..223: note = chr9:80263294-80263517
  misc_feature 1..223: note = Hyper
  source 1..223: mol_type = genomic DNA

SEQ ID NO: 130692 - DNA, 30 bp, Homo sapiens; identical to SEQ ID NO: 101221
  misc_feature 1..30: note = chr9:80263764-80263794
  misc_feature 1..30: note = Hyper
  source 1..30: mol_type = genomic DNA

SEQ ID NO: 130693 - DNA, 23 bp, Homo sapiens
  misc_feature 1..23: note = chr9:80303276-80303299
  misc_feature 1..23: note = Hypo
  source 1..23: mol_type = genomic DNA
ttcctattcggccatcttggctc

SEQ ID NO: 130694 - DNA, 30 bp, Homo sapiens; identical to SEQ ID NO: 101223
  misc_feature 1..30: note = chr9:80645516-80645546
  misc_feature 1..30: note = Hyper
  source 1..30: mol_type = genomic DNA

SEQ ID NO: 130695 - DNA, 35 bp, Homo sapiens; identical to SEQ ID NO: 101224
  misc_feature 1..35: note = chr9:80645867-80645902
  misc_feature 1..35: note = Hyper
  source 1..35: mol_type = genomic DNA

SEQ ID NO: 130696 - DNA, 186 bp, Homo sapiens; identical to SEQ ID NO: 101225
  misc_feature 1..186: note = chr9:80646323-80646509
  misc_feature 1..186: note = Hyper
  source 1..186: mol_type = genomic DNA

SEQ ID NO: 130697 - DNA, 76 bp, Homo sapiens; identical to SEQ ID NO: 101226
  misc_feature 1..76: note = chr9:80647171-80647247
  misc_feature 1..76: note = Hyper
  source 1..76: mol_type = genomic DNA

SEQ ID NO: 130698 - DNA, 58 bp, Homo sapiens; identical to SEQ ID NO: 101227
  misc_feature 1..58: note = chr9:80849784-80849842
  misc_feature 1..58: note = Hypo
  source 1..58: mol_type = genomic DNA

SEQ ID NO: 130699 - DNA, 147 bp, Homo sapiens; identical to SEQ ID NO: 101228
  misc_feature 1..147: note = chr9:80852173-80852320
  misc_feature 1..147: note = Hypo
  source 1..147: mol_type = genomic DNA

SEQ ID NO: 130700 - DNA, 145 bp, Homo sapiens; identical to SEQ ID NO: 101229
  misc_feature 1..145: note = chr9:80911891-80912036
  misc_feature 1..145: note = Hyper
  source 1..145: mol_type = genomic DNA

SEQ ID NO: 130701 - DNA, 148 bp, Homo sapiens; identical to SEQ ID NO: 101230
  misc_feature 1..148: note = chr9:81181130-81181278
  misc_feature 1..148: note = Hypo
  source 1..148: mol_type = genomic DNA

SEQ ID NO: 130702 - DNA, 154 bp, Homo sapiens; identical to SEQ ID NO: 101231
  misc_feature 1..154: note = chr9:81358951-81359105
  misc_feature 1..154: note = Hypo
  source 1..154: mol_type = genomic DNA

SEQ ID NO: 130703 - DNA, 38 bp, Homo sapiens; identical to SEQ ID NO: 101232
  misc_feature 1..38: note = chr9:82185345-82185383
  misc_feature 1..38: note = Hyper
  source 1..38: mol_type = genomic DNA

SEQ ID NO: 130704 - DNA, 60 bp, Homo sapiens; identical to SEQ ID NO: 101233
  misc_feature 1..60: note = chr9:82185643-82185703
  misc_feature 1..60: note = Hyper
  source 1..60: mol_type = genomic DNA

SEQ ID NO: 130705 - DNA, 30 bp, Homo sapiens; identical to SEQ ID NO: 101234
  misc_feature 1..30: note = chr9:82336772-82336802
  misc_feature 1..30: note = Hypo
  source 1..30: mol_type = genomic DNA

SEQ ID NO: 130706 - DNA, 71 bp, Homo sapiens; identical to SEQ ID NO: 101239
  misc_feature 1..71: note = chr9:84241090-84241161
  misc_feature 1..71: note = Hypo
  source 1..71: mol_type = genomic DNA

SEQ ID NO: 130707 - DNA, 37 bp, Homo sapiens; identical to SEQ ID NO: 101242
  misc_feature 1..37: note = chr9:84294953-84294990
  misc_feature 1..37: note = Hypo
  source 1..37: mol_type = genomic DNA

SEQ ID NO: 130708 - DNA, 17 bp, Homo sapiens
  misc_feature 1..17: note = chr9:85372740-85372757
  misc_feature 1..17: note = Hypo
  source 1..17: mol_type = genomic DNA
gacgggagctgttccta

SEQ ID NO: 130709 - DNA, 577 bp, Homo sapiens; identical to SEQ ID NO: 101244
  misc_feature 1..577: note = chr9:86152387-86152964
  misc_feature 1..577: note = Hyper
  source 1..577: mol_type = genomic DNA

SEQ ID NO: 130710 - DNA, 212 bp, Homo sapiens; identical to SEQ ID NO: 101245
  misc_feature 1..212: note = chr9:86153332-86153544
  misc_feature 1..212: note = Hyper
  source 1..212: mol_type = genomic DNA

SEQ ID NO: 130711 - DNA, 25 bp, Homo sapiens
  misc_feature 1..25: note = chr9:86537478-86537503
  misc_feature 1..25: note = Hypo
  source 1..25: mol_type = genomic DNA
ccaccctgcccggccctatcaggac

SEQ ID NO: 130712 - DNA, 581 bp, Homo sapiens; identical to SEQ ID NO: 32520
  misc_feature 1..581: note = chr9:86755532-86756113
  misc_feature 1..581: note = Hyper
  source 1..581: mol_type = genomic DNA

SEQ ID NO: 130713 - DNA, 227 bp, Homo sapiens; identical to SEQ ID NO: 101248
  misc_feature 1..227: note = chr9:86886509-86886736
  misc_feature 1..227: note = Hyper
  source 1..227: mol_type = genomic DNA

SEQ ID NO: 130714 - DNA, 767 bp, Homo sapiens; identical to SEQ ID NO: 101249
  misc_feature 1..767: note = chr9:87282999-87283766
  misc_feature 1..767: note = Hyper
  source 1..767: mol_type = genomic DNA

SEQ ID NO: 130715 - DNA, 50 bp, Homo sapiens; identical to SEQ ID NO: 101250
  misc_feature 1..50: note = chr9:87284009-87284059
  misc_feature 1..50: note = Hyper
  source 1..50: mol_type = genomic DNA

SEQ ID NO: 130716 - DNA, 439 bp, Homo sapiens; identical to SEQ ID NO: 9946
  misc_feature 1..439: note = chr9:87284555-87284994
  misc_feature 1..439: note = Hyper
  source 1..439: mol_type = genomic DNA

SEQ ID NO: 130717 - DNA, 565 bp, Homo sapiens
  misc_feature 1..565: note = chr9:87285279-87285844
  misc_feature 1..565: note = Hyper
  source 1..565: mol_type = genomic DNA
gtttgtcctcagcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagccta

SEQ ID NO: 130718 - DNA, 30 bp, Homo sapiens; identical to SEQ ID NO: 42145
  misc_feature 1..30: note = chr9:87326719-87326749
  misc_feature 1..30: note = Hypo
  source 1..30: mol_type = genomic DNA

SEQ ID NO: 130719 - DNA, 29 bp, Homo sapiens
  misc_feature 1..29: note = chr9:88137397-88137426
  misc_feature 1..29: note = Hyper
  source 1..29: mol_type = genomic DNA
acacacacgcacagacgcacactcacgtg

SEQ ID NO: 130720 - DNA, 628 bp, Homo sapiens
  misc_feature 1..628: note = chr9:88137486-88138114
  misc_feature 1..628: note = Hyper
  source 1..628: mol_type = genomic DNA
ctgtcagcaagaaaggaaggcaggctgttgagtagggaagtgggagtgcctgccggcgttctcgtctgtccctacttcatccttcctctctcactgtcttacagcaaaggactacagcaaaggcgcgttcagcgcctgcgcggccaggcccggggtgctgggttgcggcttcccgcgggtaaaccctgtcggtacccgatccccgtccgcggaaggccaggagaacgcggttccccttctcgcgtcctctcccttcccgcatctgtggataactcttcccgcatcggcctctctctgctgacattagaaagacgtccctacgccgcggcgagcttcctttgcccctaaaagcactccctttctgtgtgcaggaaaccgcccccgactccgcgcgatcgccctgtgcgcgcaggagtgacaggcgccccagctcgcgctctccagcccgccagggcccggctttggcagacccgaggctcctcacccgccctgagggacgggttgtacttactgagaactgatgcttagtaagcttaaaagccccagaaaggaagtctgtacaaatccttaatgatccagtcaattgtcgctgcataacaaaccaccccagaaccggtaacttgaaaca

SEQ ID NO: 130721 - DNA, 30 bp, Homo sapiens; identical to SEQ ID NO: 42146
  misc_feature 1..30: note = chr9:88832474-88832504
  misc_feature 1..30: note = Hypo
  source 1..30: mol_type = genomic DNA

SEQ ID NO: 130722 - DNA, 30 bp, Homo sapiens; identical to SEQ ID NO: 101261
  misc_feature 1..30: note = chr9:89083624-89083654
  misc_feature 1..30: note = Hypo
  source 1..30: mol_type = genomic DNA

SEQ ID NO: 130723 - DNA, 67 bp, Homo sapiens; identical to SEQ ID NO: 101262
  misc_feature 1..67: note = chr9:89131689-89131756
  misc_feature 1..67: note = Hypo
  source 1..67: mol_type = genomic DNA

SEQ ID NO: 130724 - DNA, 22 bp, Homo sapiens
  misc_feature 1..22: note = chr9:89330755-89330777
  misc_feature 1..22: note = Hypo
  source 1..22: mol_type = genomic DNA
ttacaggcgtgagccactgcgc

SEQ ID NO: 130725 - DNA, 30 bp, Homo sapiens; identical to SEQ ID NO: 101264
  misc_feature 1..30: note = chr9:89374984-89375014
  misc_feature 1..30: note = Hypo
  source 1..30: mol_type = genomic DNA

SEQ ID NO: 130726 - DNA, 127 bp, Homo sapiens
  misc_feature 1..127: note = chr9:89517708-89517835
  misc_feature 1..127: note = Hyper
  source 1..127: mol_type = genomic DNA
ttcccccggcctctgcgggggcgcgcgggctgggaaagggacgaaatggaaaaaccgtcccctccagcaccctcacctccaccgccaccctcacctccaccgccgccgagcccggggtcaaagctgc

SEQ ID NO: 130727 - DNA, 30 bp, Homo sapiens; identical to SEQ ID NO: 101265
  misc_feature 1..30: note = chr9:89518042-89518072
  misc_feature 1..30: note = Hyper
  source 1..30: mol_type = genomic DNA

SEQ ID NO: 130728 - DNA, 624 bp, Homo sapiens; identical to SEQ ID NO: 101266
  misc_feature 1..624: note = chr9:89560694-89561318
  misc_feature 1..624: note = Hyper
  source 1..624: mol_type = genomic DNA

SEQ ID NO: 130729 - DNA, 30 bp, Homo sapiens; identical to SEQ ID NO: 101267
  misc_feature 1..30: note = chr9:89561749-89561779
  misc_feature 1..30: note = Hyper
  source 1..30: mol_type = genomic DNA

SEQ ID NO: 130730 - DNA, 82 bp, Homo sapiens; identical to SEQ ID NO: 101268
  misc_feature 1..82: note = chr9:89563765-89563847
  misc_feature 1..82: note = Hyper
  source 1..82: mol_type = genomic DNA

SEQ ID NO: 130731 - DNA, 299 bp, Homo sapiens; identical to SEQ ID NO: 101269
  misc_feature 1..299: note = chr9:89763321-89763620
  misc_feature 1..299: note = Hyper
  source 1..299: mol_type = genomic DNA

SEQ ID NO: 130732 - DNA, 30 bp, Homo sapiens; identical to SEQ ID NO: 101270
  misc_feature 1..30: note = chr9:90000239-90000269
  misc_feature 1..30: note = Hypo
  source 1..30: mol_type = genomic DNA

SEQ ID NO: 130733 - DNA, 66 bp, Homo sapiens; identical to SEQ ID NO: 101271
  misc_feature 1..66: note = chr9:90112790-90112856
  misc_feature 1..66: note = Hyper
  source 1..66: mol_type = genomic DNA

SEQ ID NO: 130734 - DNA, 30 bp, Homo sapiens; identical to SEQ ID NO: 101272
  misc_feature 1..30: note = chr9:90113126-90113156
  misc_feature 1..30: note = Hyper
  source 1..30: mol_type = genomic DNA

SEQ ID NO: 130735 - DNA, 113 bp, Homo sapiens
  misc_feature 1..113: note = chr9:90113665-90113778
  misc_feature 1..113: note = Hyper
  source 1..113: mol_type = genomic DNA
gggtgccgtggtgcccggccccacgcgcgcgcggggctgaggggtcgggggcgtccctggccgcccagctttaacaaagggtgctcctctccaccccgcgaggaggggcagct

SEQ ID NO: 130736 - DNA, 30 bp, Homo sapiens; identical to SEQ ID NO: 101274
  misc_feature 1..30: note = chr9:90279219-90279249
  misc_feature 1..30: note = Hypo
  source 1..30: mol_type = genomic DNA

SEQ ID NO: 130737 - DNA, 161 bp, Homo sapiens; identical to SEQ ID NO: 101275
  misc_feature 1..161: note = chr9:90287605-90287766
  misc_feature 1..161: note = Hypo
  source 1..161: mol_type = genomic DNA

SEQ ID NO: 130738 - DNA, 30 bp, Homo sapiens; identical to SEQ ID NO: 101276
  misc_feature 1..30: note = chr9:90316457-90316487
  misc_feature 1..30: note = Hypo
  source 1..30: mol_type = genomic DNA

SEQ ID NO: 130739 - DNA, 49 bp, Homo sapiens; identical to SEQ ID NO: 101277
  misc_feature 1..49: note = chr9:90321063-90321112
  misc_feature 1..49: note = Hypo
  source 1..49: mol_type = genomic DNA

SEQ ID NO: 130740 - DNA, 165 bp, Homo sapiens; identical to SEQ ID NO: 42147
  misc_feature 1..165: note = chr9:90322123-90322288
  misc_feature 1..165: note = Hypo
  source 1..165: mol_type = genomic DNA

SEQ ID NO: 130741 - DNA, 170 bp, Homo sapiens; identical to SEQ ID NO: 101279
  misc_feature 1..170: note = chr9:90331505-90331675
  misc_feature 1..170: note = Hypo
  source 1..170: mol_type = genomic DNA

SEQ ID NO: 130742 - DNA, 98 bp, Homo sapiens; identical to SEQ ID NO: 101280
  misc_feature 1..98: note = chr9:90340845-90340943
  misc_feature 1..98: note = Hyper
  source 1..98: mol_type = genomic DNA

SEQ ID NO: 130743 - DNA, 79 bp, Homo sapiens; identical to SEQ ID NO: 101281
  misc_feature 1..79: note = chr9:90341264-90341343
  misc_feature 1..79: note = Hyper
  source 1..79: mol_type = genomic DNA

SEQ ID NO: 130744 - DNA, 30 bp, Homo sapiens; identical to SEQ ID NO: 101282
  misc_feature 1..30: note = chr9:90386516-90386546
  misc_feature 1..30: note = Hypo
  source 1..30: mol_type = genomic DNA

SEQ ID NO: 130745 - DNA, 173 bp, Homo sapiens; identical to SEQ ID NO: 101283
  misc_feature 1..173: note = chr9:90421580-90421753
  misc_feature 1..173: note = Hypo
  source 1..173: mol_type = genomic DNA

SEQ ID NO: 130746 - DNA, 30 bp, Homo sapiens; identical to SEQ ID NO: 101284
  misc_feature 1..30: note = chr9:90588928-90588958
  misc_feature 1..30: note = Hyper
  source 1..30: mol_type = genomic DNA

SEQ ID NO: 130747 - DNA, 93 bp, Homo sapiens; identical to SEQ ID NO: 32533
  misc_feature 1..93: note = chr9:90589194-90589287
  misc_feature 1..93: note = Hyper
  source 1..93: mol_type = genomic DNA

SEQ ID NO: 130748 - DNA, 184 bp, Homo sapiens; identical to SEQ ID NO: 101286
  misc_feature 1..184: note = chr9:90589592-90589776
  misc_feature 1..184: note = Hyper
  source 1..184: mol_type = genomic DNA

SEQ ID NO: 130749 - DNA, 84 bp, Homo sapiens; identical to SEQ ID NO: 101287
  misc_feature 1..84: note = chr9:90691103-90691187
  misc_feature 1..84: note = Hyper
  source 1..84: mol_type = genomic DNA

SEQ ID NO: 130750 - DNA, 103 bp, Homo sapiens; identical to SEQ ID NO: 101288
  misc_feature 1..103: note = chr9:90749344-90749447
  misc_feature 1..103: note = Hypo
  source 1..103: mol_type = genomic DNA

SEQ ID NO: 130751 - DNA, 193 bp, Homo sapiens; identical to SEQ ID NO: 101289
  misc_feature 1..193: note = chr9:91149133-91149326
  misc_feature 1..193: note = Hyper
  source 1..193: mol_type = genomic DNA

SEQ ID NO: 130752 - DNA, 30 bp, Homo sapiens; identical to SEQ ID NO: 101290
  misc_feature 1..30: note = chr9:91149724-91149754
  misc_feature 1..30: note = Hyper
  source 1..30: mol_type = genomic DNA

SEQ ID NO: 130753 - DNA, 409 bp, Homo sapiens; identical to SEQ ID NO: 101291
  misc_feature 1..409: note = chr9:91149976-91150385
  misc_feature 1..409: note = Hyper
  source 1..409: mol_type = genomic DNA

SEQ ID NO: 130754 - DNA, 40 bp, Homo sapiens; identical to SEQ ID NO: 32536
  misc_feature 1..40: note = chr9:91150621-91150661
  misc_feature 1..40: note = Hyper
  source 1..40: mol_type = genomic DNA

SEQ ID NO: 130755 - DNA, 69 bp, Homo sapiens; identical to SEQ ID NO: 101293
  misc_feature 1..69: note = chr9:91321072-91321141
  misc_feature 1..69: note = Hypo
  source 1..69: mol_type = genomic DNA

SEQ ID NO: 130756 - DNA, 398 bp, Homo sapiens; identical to SEQ ID NO: 32537
  misc_feature 1..398: note = chr9:91605965-91606363
  misc_feature 1..398: note = Hyper
  source 1..398: mol_type = genomic DNA

SEQ ID NO: 130757 - DNA, 30 bp, Homo sapiens; identical to SEQ ID NO: 32538
  misc_feature 1..30: note = chr9:91606806-91606836
  misc_feature 1..30: note = Hyper
  source 1..30: mol_type = genomic DNA

SEQ ID NO: 130758 - DNA, 1242 bp, Homo sapiens; identical to SEQ ID NO: 101296
  misc_feature 1..1242: note = chr9:91792357-91793599
  misc_feature 1..1242: note = Hyper
  source 1..1242: mol_type = genomic DNA

SEQ ID NO: 130759 - DNA, 344 bp, Homo sapiens; identical to SEQ ID NO: 101297
  misc_feature 1..344: note = chr9:91849514-91849858
  misc_feature 1..344: note = Hyper
  source 1..344: mol_type = genomic DNA

SEQ ID NO: 130760 - DNA, 30 bp, Homo sapiens; identical to SEQ ID NO: 101298
  misc_feature 1..30: note = chr9:91870244-91870274
  misc_feature 1..30: note = Hypo
  source 1..30: mol_type = genomic DNA

SEQ ID NO: 130761 - DNA, 267 bp, Homo sapiens; identical to SEQ ID NO: 101299
  misc_feature 1..267: note = chr9:91995936-91996203
  misc_feature 1..267: note = Hypo
  source 1..267: mol_type = genomic DNA

SEQ ID NO: 130762 - DNA, 101 bp, Homo sapiens; identical to SEQ ID NO: 101300
  misc_feature 1..101: note = chr9:92163460-92163561
  misc_feature 1..101: note = Hypo
  source 1..101: mol_type = genomic DNA

SEQ ID NO: 130763 - DNA, 30 bp, Homo sapiens; identical to SEQ ID NO: 101301
  misc_feature 1..30: note = chr9:92800931-92800961
  misc_feature 1..30: note = Hypo
  source 1..30: mol_type = genomic DNA

SEQ ID NO: 130764 - DNA, 159 bp, Homo sapiens; identical to SEQ ID NO: 42151
  misc_feature 1..159: note = chr9:92897057-92897216
  misc_feature 1..159: note = Hypo
  source 1..159: mol_type = genomic DNA

SEQ ID NO: 130765 - DNA, 77 bp, Homo sapiens; identical to SEQ ID NO: 15229
  misc_feature 1..77: note = chr9:92980516-92980593
  misc_feature 1..77: note = Hypo
  source 1..77: mol_type = genomic DNA

SEQ ID NO: 130766 - DNA, 290 bp, Homo sapiens; identical to SEQ ID NO: 101304
  misc_feature 1..290: note = chr9:93404961-93405251
  misc_feature 1..290: note = Hyper
  source 1..290: mol_type = genomic DNA

SEQ ID NO: 130767 - DNA, 197 bp, Homo sapiens; identical to SEQ ID NO: 101305
  misc_feature 1..197: note = chr9:93462703-93462900
  misc_feature 1..197: note = Hypo
  source 1..197: mol_type = genomic DNA

SEQ ID NO: 130768 - DNA, 46 bp, Homo sapiens; identical to SEQ ID NO: 101306
  misc_feature 1..46: note = chr9:93564410-93564456
  misc_feature 1..46: note = Hyper
  source 1..46: mol_type = genomic DNA

SEQ ID NO: 130769 - DNA, 32 bp, Homo sapiens; identical to SEQ ID NO: 101307
  misc_feature 1..32: note = chr9:93698029-93698061
  misc_feature 1..32: note = Hypo
  source 1..32: mol_type = genomic DNA

SEQ ID NO: 130770 - DNA, 158 bp, Homo sapiens; identical to SEQ ID NO: 101308
  misc_feature 1..158: note = chr9:93901190-93901348
  misc_feature 1..158: note = Hypo
  source 1..158: mol_type = genomic DNA

SEQ ID NO: 130771 - DNA, 248 bp, Homo sapiens; identical to SEQ ID NO: 101309
  misc_feature 1..248: note = chr9:93955929-93956177
  misc_feature 1..248: note = Hyper
  source 1..248: mol_type = genomic DNA

SEQ ID NO: 130772 - DNA, 213 bp, Homo sapiens; identical to SEQ ID NO: 101310
  misc_feature 1..213: note = chr9:93956444-93956657
  misc_feature 1..213: note = Hyper
  source 1..213: mol_type = genomic DNA

SEQ ID NO: 130773 - DNA, 480 bp, Homo sapiens; identical to SEQ ID NO: 101311
  misc_feature 1..480: note = chr9:94183464-94183944
  misc_feature 1..480: note = Hyper
  source 1..480: mol_type = genomic DNA

SEQ ID NO: 130774 - DNA, 32 bp, Homo sapiens; identical to SEQ ID NO: 101312
  misc_feature 1..32: note = chr9:94187211-94187243
  misc_feature 1..32: note = Hyper
  source 1..32: mol_type = genomic DNA

SEQ ID NO: 130775 - DNA, 42 bp, Homo sapiens; identical to SEQ ID NO: 101313
  misc_feature 1..42: note = chr9:94486293-94486335
  misc_feature 1..42: note = Hypo
  source 1..42: mol_type = genomic DNA

SEQ ID NO: 130776 - DNA, 30 bp, Homo sapiens; identical to SEQ ID NO: 42155
  misc_feature 1..30: note = chr9:94572598-94572628
  misc_feature 1..30: note = Hypo
  source 1..30: mol_type = genomic DNA

SEQ ID NO: 130777 - DNA, 87 bp, Homo sapiens; identical to SEQ ID NO: 101315
  misc_feature 1..87: note = chr9:94573085-94573172
  misc_feature 1..87: note = Hypo
  source 1..87: mol_type = genomic DNA

SEQ ID NO: 130778 - DNA, 93 bp, Homo sapiens; identical to SEQ ID NO: 101316
  misc_feature 1..93: note = chr9:94579436-94579529
  misc_feature 1..93: note = Hypo
  source 1..93: mol_type = genomic DNA

SEQ ID NO: 130779 - DNA, 141 bp, Homo sapiens; identical to SEQ ID NO: 42157
  misc_feature 1..141: note = chr9:94658109-94658250
  misc_feature 1..141: note = Hypo
  source 1..141: mol_type = genomic DNA

SEQ ID NO: 130780 - DNA, 22 bp, Homo sapiens
  misc_feature 1..22: note = chr9:94685022-94685044
  misc_feature 1..22: note = Hypo
  source 1..22: mol_type = genomic DNA
ccgcgcccgaccaagaatattt

SEQ ID NO: 130781 - DNA, 1986 bp, Homo sapiens
  misc_feature 1..1986: note = chr9:94711102-94713088
  misc_feature 1..1986: note = Hyper
  source 1..1986: mol_type = genomic DNA
tgggcctgaaggccccgcccgccctcctccacccccgcagggtgccgagaatccggcccgaggcgcgcgggcgggaggtgctcccggagtctgcaccgccagagctaacgccgcctcctccaggcaacctaggcaggtcccaagctgcacttccgaacctccccgccgttcctctgcgccccggatccaagcagccgaaaccgcgcagggactcgggggaagtggggccccgggaggaaacccacctaggagccgggccccgcccctcccgccgccagcctcctacaggtcccgggggtccccccggcgcggccagaaggcggccgcgccccagccgctcagggacccgcgatcccagtcacaaaccatttcaatccagatcacacaccacttcggccaccccagagcggtgggggagaggaggtttcagggaccaacaaaagggatgccaaagagcccgtttccatcaagcggcccgcgggctgggaaagtcaggacccgggagccgccggcgcccccacccccgccgcaagagccgcttctccggggccacgtccaccccaggattctgccaggcatcaggccgccctgggggtggggggacgctccgagacagacgggggacactcggggccgtgtgcccttgaaggaggaagacctcggggaggaagcccgggtcctgggaccctcggggcacatctgcggactcgggtcccgggcccagggcgggtactcacattcacactcgcactcccactcgcgaccctcgggaagcgccaccgagaggctcccagccgccgccgcccgcccccagactctggaaacacttaggcgtccccagagcgcggcttattgtaaccagcccgagggggtccggggtgcgggccgggagcggcgtcgggcgagatgcgaatggccctgcctggcgcccctcgttcaggagcatgggcgccggcgcagcggccgggagcatagtggcggcggaagggctggccaagcgagccgtgagctaccgtctgcgcacaagccggaacgccagatcctacctgaagtccgggacactgagagcagaagcgcggcggccgcccagacggccgggatgcacagcagcggccgccgcgggagcgccgagccccgggccatgccgcaggcagtgggggccgggaagccctcagagcttcgggccggggcgcggggtcgggcgccaccacccctttctacgatgcgtccgctcctccttctccctggcgcttcgcaaacgggtccacttcgaggacctcgtcgtcgtcctcttctccggcccggatgcgccgctcggctccggccacggcaagggctggctggggaggttccttggcgcgggctggggcgtcccgccggccgccaggacgagcgcggggggcggaccgcgggcgagcgcgcaggaggcagggtccccgctcgcccgccccgatgggcagagcgaggcttgcgccggcgccccctgccgggggaacgcgcgggcggcgggcgggacccaaggagctggggctgcagctggggccccggacctgcctcctgcgcccgccctcgggcctgcgcctcggaacgcttgaacacaaaggtggcgccttgggggcgtcagccggagttcggcgggtctgcccacgcaggagaggcgcccagagcgggtgcccccgactttcgggggcgacacacccggggatctaggtcacaaatcagtaactccaggctgcactgcgcaccgggacaaatctgagagccacccagccccagacaccagcggtgaggcaggaagaggagaagcgaaagttgcaaaaggaaatgttcaggaaaacaaacaggccgccttggcaccggcgccctcccaggtcggtggggacaagcgcgtcccccgaaatgctcaaaactgccaggggtcgagctgcgtggagggagccctcgggagcgcgatgctatccgaagccaccgcggcttttggtttac

SEQ ID NO: 130782 - DNA, 30 bp, Homo sapiens; identical to SEQ ID NO: 101321
  misc_feature 1..30: note = chr9:94746198-94746228
  misc_feature 1..30: note = Hypo
  source 1..30: mol_type = genomic DNA

SEQ ID NO: 130783 - DNA, 137 bp, Homo sapiens; identical to SEQ ID NO: 101322
  misc_feature 1..137: note = chr9:94862789-94862926
  misc_feature 1..137: note = Hypo
  source 1..137: mol_type = genomic DNA

SEQ ID NO: 130784 - DNA, 102 bp, Homo sapiens; identical to SEQ ID NO: 101323
  misc_feature 1..102: note = chr9:94863469-94863571
  misc_feature 1..102: note = Hypo
  source 1..102: mol_type = genomic DNA

SEQ ID NO: 130785 - DNA, 245 bp, Homo sapiens; identical to SEQ ID NO: 101324
  misc_feature 1..245: note = chr9:94934584-94934829
  misc_feature 1..245: note = Hypo
  source 1..245: mol_type = genomic DNA

SEQ ID NO: 130786 - DNA, 30 bp, Homo sapiens; identical to SEQ ID NO: 101325
  misc_feature 1..30: note = chr9:95416325-95416355
  misc_feature 1..30: note = Hypo
  source 1..30: mol_type = genomic DNA

SEQ ID NO: 130787 - DNA, 169 bp, Homo sapiens; identical to SEQ ID NO: 101326
  misc_feature 1..169: note = chr9:95417482-95417651
  misc_feature 1..169: note = Hypo
  source 1..169: mol_type = genomic DNA

SEQ ID NO: 130788 - DNA, 30 bp, Homo sapiens; identical to SEQ ID NO: 101327
  misc_feature 1..30: note = chr9:95442637-95442667
  misc_feature 1..30: note = Hypo
  source 1..30: mol_type = genomic DNA

SEQ ID NO: 130789 - DNA, 310 bp, Homo sapiens; identical to SEQ ID NO: 101328
  misc_feature 1..310: note = chr9:95485043-95485353
  misc_feature 1..310: note = Hypo
  source 1..310: mol_type = genomic DNA

SEQ ID NO: 130790 - DNA, 30 bp, Homo sapiens; identical to SEQ ID NO: 101329
  misc_feature 1..30: note = chr9:95501326-95501356
  misc_feature 1..30: note = Hypo
  source 1..30: mol_type = genomic DNA

SEQ ID NO: 130791 - DNA, 65 bp, Homo sapiens; identical to SEQ ID NO: 101330
  misc_feature 1..65: note = chr9:95560810-95560875
  misc_feature 1..65: note = Hypo
  source 1..65: mol_type = genomic DNA

SEQ ID NO: 130792 - DNA, 1045 bp, Homo sapiens; identical to SEQ ID NO: 101331
  misc_feature 1..1045: note = chr9:95569676-95570721
  misc_feature 1..1045: note = Hyper
  source 1..1045: mol_type = genomic DNA

SEQ ID NO: 130793 - DNA, 85 bp, Homo sapiens; identical to SEQ ID NO: 101332
  misc_feature 1..85: note = chr9:95570901-95570986
  misc_feature 1..85: note = Hyper
  source 1..85: mol_type = genomic DNA

SEQ ID NO: 130794 - DNA, 337 bp, Homo sapiens; identical to SEQ ID NO: 101333
  misc_feature 1..337: note = chr9:95571355-95571692
  misc_feature 1..337: note = Hyper
  source 1..337: mol_type = genomic DNA

SEQ ID NO: 130795 - DNA, 516 bp, Homo sapiens; identical to SEQ ID NO: 101334
  misc_feature 1..516: note = chr9:95571752-95572268
  misc_feature 1..516: note = Hyper
  source 1..516: mol_type = genomic DNA

SEQ ID NO: 130796 - DNA, 159 bp, Homo sapiens; identical to SEQ ID NO: 101335
  misc_feature 1..159: note = chr9:95709693-95709852
  misc_feature 1..159: note = Hyper
  source 1..159: mol_type = genomic DNA

SEQ ID NO: 130797 - DNA, 243 bp, Homo sapiens; identical to SEQ ID NO: 101336
  misc_feature 1..243: note = chr9:95821220-95821463
  misc_feature 1..243: note = Hyper
  source 1..243: mol_type = genomic DNA

SEQ ID NO: 130798 - DNA, 430 bp, Homo sapiens; identical to SEQ ID NO: 101337
  misc_feature 1..430: note = chr9:95946132-95946562
  misc_feature 1..430: note = Hyper
  source 1..430: mol_type = genomic DNA

SEQ ID NO: 130799 - DNA, 30 bp, Homo sapiens; identical to SEQ ID NO: 101338
  misc_feature 1..30: note = chr9:95946829-95946859
  misc_feature 1..30: note = Hyper
  source 1..30: mol_type = genomic DNA

SEQ ID NO: 130800 - DNA, 36 bp, Homo sapiens; identical to SEQ ID NO: 101339
  misc_feature 1..36: note = chr9:95947222-95947258
  misc_feature 1..36: note = Hyper
  source 1..36: mol_type = genomic DNA

SEQ ID NO: 130801 - DNA, 110 bp, Homo sapiens; identical to SEQ ID NO: 101340
  misc_feature 1..110: note = chr9:96024041-96024151
  misc_feature 1..110: note = Hypo
  source 1..110: mol_type = genomic DNA

SEQ ID NO: 130802 - DNA, 23 bp, Homo sapiens
  misc_feature 1..23: note = chr9:96230169-96230192
  misc_feature 1..23: note = Hypo
  source 1..23: mol_type = genomic DNA
cttttttttttgagacggagttt

SEQ ID NO: 130803 - DNA, 57 bp, Homo sapiens; identical to SEQ ID NO: 101342
  misc_feature 1..57: note = chr9:96362025-96362082
  misc_feature 1..57: note = Hypo
  source 1..57: mol_type = genomic DNA

SEQ ID NO: 130804 - DNA, 48 bp, Homo sapiens; identical to SEQ ID NO: 101343
  misc_feature 1..48: note = chr9:96436127-96436175
  misc_feature 1..48: note = Hypo
  source 1..48: mol_type = genomic DNA

SEQ ID NO: 130805 - DNA, 28 bp, Homo sapiens
  misc_feature 1..28: note = chr9:96573710-96573738
  misc_feature 1..28: note = Hypo
  source 1..28: mol_type = genomic DNA
tttttttttttgagacggagtctcgctc

SEQ ID NO: 130806 - DNA, 371 bp, Homo sapiens
  misc_feature 1..371: note = chr9:96588601-96588972
  misc_feature 1..371: note = Hyper
  source 1..371: mol_type = genomic DNA
cgccgccaccattcccgttccggttggagaacacaatgcaccgcgcacaggctgtgccaaagtccacaggcacccttcggcctccatcatcgcgccctcttcacagatgagcaaacggaggccagacgtcaccggcaggcggcgctgcggtgcgcgaggcctcgcacctgcacgggaagcagcggagaggacgcaggtaaggtaaagccaggcagacccgaacctggacgcgcacctgcgggggagggggtatgcgcggggcgggttgccgcccctcccgggagtacgggcggaggcaggggcgggcgggggctttcagcagctcgtccgcggaacatttgcatgtaatttgggagcgggtcacatgtggg

SEQ ID NO: 130807 - DNA, 130 bp, Homo sapiens; identical to SEQ ID NO: 101347
  misc_feature 1..130: note = chr9:96590139-96590269
  misc_feature 1..130: note = Hyper
  source 1..130: mol_type = genomic DNA

SEQ ID NO: 130808 - DNA, 430 bp, Homo sapiens
  misc_feature 1..430: note = chr9:96708129-96708559
  misc_feature 1..430: note = Hyper
  source 1..430: mol_type = genomic DNA
cagctccctcggggtcgagtccctctgcgtgtcctcccctacctcggcctccacctgccccttgcacgggcggcgccgcctgccatgcgcagcacgagcctcgctaatgcgtttcgcatggcgcgtcagtcaaacgcccttctaatgtccttaaagcacgcagaaaattgcatccttatgaaaaaggagaaaaaaagcaaattgcctggtggaagcggagctgccgcgggggctggggcggcagcgcgtgcgggcggagttgcgttcggcagggcggacttggggcggctgtcaggggctctcccgggccaaggcgcaagagcaagacgctgcctcctcccagcgcttccaagtggcgcctgggcccacatccttgcctgctctctcccactcttccacctctccttgctcgttccggacaccctggcct

SEQ ID NO: 130809 - DNA, 352 bp, Homo sapiens; identical to SEQ ID NO: 101349
  misc_feature 1..352: note = chr9:96710044-96710396
  misc_feature 1..352: note = Hyper
  source 1..352: mol_type = genomic DNA

SEQ ID NO: 130810 - DNA, 1033 bp, Homo sapiens
  misc_feature 1..1033: note = chr9:96710664-96711697
  misc_feature 1..1033: note = Hyper
  source 1..1033: mol_type = genomic DNA
acttgggctgggacccgcgcttcttcttttttttttttctttcttagtccccacaagtgaccctctaggggaatccagaacagggaagggagcaagccagaggaactttttttttttttaggtgaaaagccagggggagggatggggcgcccccgctcgcgactacgcctgcgactgtcctcgcgctgcgggggctgtgcgtggagcccgcggtaagctggaatatccaagccagctgcaagtggccttccgttccccacacgcctcctgcgtgctgggcccagctgggcgccgcccaaatcttctctctcccgagactctccagctccccttctactgaccaggagaacgtcttgctccggccaggatcacaccagtggagaagcgaccccctcccccatcccgggccggggcccttctgacaagcctccccaaggactccctcattccccaggccaccttgaacaaagcacactgagcgcaaacttcgcgcctctgggggaacgctgcggccaggctaatcccagccctctctcctcccccagcccttcgcgtccccagggtccaggcggtcgcaggcgctccccactcccgcagggccacagctctcgcgagactcctgagccctctccctcccctggctgcggcccccgggctccgggaagctcagccacctgggcccacgccatatctgggtttttttcccaggactttggggatgagaagagacttgtgcatagagcggaagaggaatgggatccaagggacctttccttcaagtcccgggcctgaaatgaaggatgcgactgctgcctgcaggcagagagacaacctcagcgctcggtggctggggcgcagtggcacgcagggcgggcgccaggtagctccggtcgggcacgcgcagtccgacagactgtgtcaccttggaagacaggatgcggccctttacctagagtggcagctttgtgggctaggtcagcacggggtctccgggccggcgggcaatcgtctgcctctgcgccttagctccctg

SEQ ID NO: 130811 - DNA, 30 bp, Homo sapiens; identical to SEQ ID NO: 101352
  misc_feature 1..30: note = chr9:96711975-96712005
  misc_feature 1..30: note = Hyper
  source 1..30: mol_type = genomic DNA

SEQ ID NO: 130812 - DNA, 30 bp, Homo sapiens; identical to SEQ ID NO: 101353
  misc_feature 1..30: note = chr9:96712723-96712753
  misc_feature 1..30: note = Hyper
  source 1..30: mol_type = genomic DNA

SEQ ID NO: 130813 - DNA, 974 bp, Homo sapiens
  misc_feature 1..974: note = chr9:96713146-96714120
  misc_feature 1..974: note = Hyper
  source 1..974: mol_type = genomic DNA
gcccagcctagactgcgggaaggcaactgagacctccatgagaagggggcacctgagagcacatgcaaccaagctgtgtccctgcaagggaccaccctccctaggccggtgtcagctgagtcctctctctccgtcggccaggtgccctcactgcccagaggtggaactcagcagcccaggcgccgccgccctgagtatcctgcggaaaatgtgagaactctggggagccattgctgctgcaaggacccgcgggcgggctaccgcgctggtgggggggctctgtccaaaccttgcgtcctcgacttcccatccgcctcataaagggttggtgaagaccatctcaaggaccgcacgaactggtccttcaagtcccaggaaaccgaaacaacaaccgaggcggctctctgtccgggccacttccggagcgagctctgcggcggacctctggctcccgctcctttgggcacccgcggtgcggccagaccgctcctgccagcgactctctggctggcaagggagaggaggtggagttcagactggcccctcacgcccagagtggaagcgattcctaggatcctgcagccaccgagccgcccgccgtgcctagcccgggcttgatggtgaagagcacagctgccttcgacagagccggaggaaaggaagtttaagaagcaactgcccgcgttccgcttatcttgccgagcccacccccacccccaccctcaccccctgcggattcagaagctgctccaccgagcccgattgtgtcataaaatattttattggaaaaaaagtcaccgtcttcgcaagagggggtaggggccccagcgacatcggggacccggcctccaggccgagccgacgggttgccccggggcaatctcaggccgttgtggcctgagcccaaccgctgggtccccgacgtccagaagcgggtgtgtgcctggaggctccccggccgggagggcaggccc

SEQ ID NO: 130814 - DNA, 111 bp, Homo sapiens
  misc_feature 1..111: note = chr9:96714344-96714455
  misc_feature 1..111: note = Hyper
  source 1..111: mol_type = genomic DNA
agtaaacttcttggacgcggaagggccggctcgcgggtttccgccgagtgagggggctgcgggtggcgcgggcatcccaggccccgcaccgtataccgccctcagtcctcg

SEQ ID NO: 130815 - DNA, 112 bp, Homo sapiens; identical to SEQ ID NO: 101355
  misc_feature 1..112: note = chr9:96714862-96714974
  misc_feature 1..112: note = Hyper
  source 1..112: mol_type = genomic DNA

SEQ ID NO: 130816 - DNA, 475 bp, Homo sapiens
  misc_feature 1..475: note = chr9:96715226-96715701
  misc_feature 1..475: note = Hyper
  source 1..475: mol_type = genomic DNA
ccatcagctgcagctcggtgaacacagtgcggctccgacgccccttcttggctttggtgcctggctccccagggcctgccgcctccagcttcccgcggagctgcaactcgagcggcaggtgtggcgcacccgcggcgccgggcagcccgggccctgccgccagcaacgcagagctcagccctgaacagcccagcggcgccagtgggaacttgaacaccgccgcctgctcggccttcagcacggctgcgaagaaagagaatgaggacccgggtgagctacggccgcgctcctctgccccagggactgccgcaccacgtgccgcgggggtgctcgcgcttggccagtgcctcccagcgcaaaacctccacgccctgccggtcggcgccggtggcgcagatggagaccctcctcaacgttgccgttccccagatttgggagggagtatctcctcgaccctgtccgtgttctgtcctgg

SEQ ID NO: 130817 - DNA, 966 bp, Homo sapiens
  misc_feature 1..966: note = chr9:96716667-96717633
  misc_feature 1..966: note = Hyper
  source 1..966: mol_type = genomic DNA
agcaggtccgcactgcggccaaggccgcgttcctcgcccgctggagctcccggggactccgggccggcttgggcccgcgtcagcacccagccctcgggagcgcaggcctcctccccagaggtccgacttccctgggttgggcagccgcggccactcccggccatccctctgcggcgaagcccaggcgcccgtggcctgaggtcgcttccacccacgagagtccgtagcctggcagtgcgcctgcactggggatgctcactcggggtccccgggctggaggccgaagggaagcagtgaaggaaagagcgaacaccctccccgggcggcccgcgggcacgaggcctggtttctgtgaggcctggagcttgcaccctccgcctcccgcctggagggctccgagagacggtcccagaacctgcgctcccagagcagcttcccggggctgcttcgatgccggaggaggctcggggcgcccccgcggttcagctcgctgtctcccgccaagcccggcccgcgaccccgcggccgccacacgtacccaggtggctgtggaagggccgcgccgccagcagcgcctgcacgccgaacttcagcagctcgcccgccgcggcagcggcggctgcgggcgcggcgcccttgggcccgggtggctccgtgaggatctcctcaatcatgaagctgcgatagcggtgcggccggtggtccgcgcagccctcgggcgggccgaagcgcgcggcgcccggctcccccggccgctgcatcgcggcgcccactgctgcgcccgcggtttggcggcggcggcggcgacggcttggctccggcgcggggcccgcgcggggctctaggccggcccgcagctcggggcggcgcgcgggcgccggctcatgccccctcccccgccggccggccgggcggaggcgcagggcgcgggcggggcgcgcggggctcggccggtcgaacccggga

SEQ ID NO: 130818 - DNA, 408 bp, Homo sapiens; identical to SEQ ID NO: 101361
  misc_feature 1..408: note = chr9:96717848-96718256
  misc_feature 1..408: note = Hyper
  source 1..408: mol_type = genomic DNA

SEQ ID NO: 130819 - DNA, 1200 bp, Homo sapiens
  misc_feature 1..1200: note = chr9:96720841-96722041
  misc_feature 1..1200: note = Hyper
  source 1..1200: mol_type = genomic DNA
ggacacaccccctcccgaggcctctagccgccgccgcgaaaatcccggaaaccgtcctgctcgcggcgggcgcagtggaaaaggtgacctcagcgccccgggccagccgccctccctagcagccgggcggcgaggggctccgggcggcaggggttcctcggcgccgcccggtcgctggatgaggggccctcggagcgcagaaccggccccctccccacccatgttctgcccctcagaccctacagcccctttggaggctgcgggacagggaggggaccacctcattcccacaaccgaatcccctaagcattcaggtgtaggttccagaaccacctcccctccacccacacccttctcctactccagcgcctcccagacgggattgtgaaatggctccgcgtgcgaacgggtccaggagccgttcgttgtacagaggaggaagctaagtctggaaggagcactcgagcaggctcagcggccagcagccagcggcagggggatcgtgcatcgcttggagggcgctgggctctcctccatccgcctcagccgtgggcagtttgtttccgctcccacttgcagcgggtctgcatcttaattggcaaaacgaagttggggccgcggtggagcggaggcttcttccagaacggtcagctcacctccggatgcggtcgtccgagcagccgcctgcggggggtcccacgccctctatctaacaggttgacgtccagcccctaggggcccaggcggccccgggccgccccacctcgcggccttctgctccccgcgcagccttgcgcgcccagccacccagcacacggtccgtccctggggacgcgtcgcgagcgccgggaatggagctcgtttcctcttttcttttttcttcttcttcttttttttttttaaacctttggttctgattgtccttggcccagcaggctgttggtggcgttggtggtgctgctgggactggggcaccggccttggccgcaggtgtgctgtgcccgacagaggccgcctggaccgcgcccggaacgccctgtccgggtgggctgcggcgttcgccctgcttttgccccgagccgagactggcaacatcttttctagcttcaaaacagaaaattttggaattataaaattaccccctccccacgcttacaggtcattatctcctggagaccaccaactcgctttctctttgga

SEQ ID NO: 130820 - DNA, 790 bp, Homo sapiens
  misc_feature 1..790: note = chr9:96722561-96723351
  misc_feature 1..790: note = Hyper
  source 1..790: mol_type = genomic DNA
tccaggaacctgaggcgatgctcctggactcgcggagccgccagcccgccgctcccagccctccaggccctggacgggtcccgcctccatttcacacccaccgctcgccagccccggcggctcccgcagagaccttgcatccgagtccagttacgcgaaccagcggcgcctgaggccacacccagagccaggaagtagccgtctgggtgccggggctctgtgggcacggccgcgctgctgggcgcggactgcaaggccgggcggggatggtgtttgcgacccgcacaggcgctctccccccggcgagtgtggacccttcgagaatgctcccttggcccaggactgatccccacgagcatacagcttcggccttccgaggagagtcagggtcggtgcggaccgactccgcaggccctcccttgccccatctgggctggtgccaggccgcagctcgagacctggtttccaccccgggctcccacagagcccatgaagcgctggtcacagcccctggaagctgcagacccggcttttcgaggagcctccccgacgtgcagagcctgagaccccagagagcggccggctcgtgcgggccagaacgcggcgaggcgcccgcggaaacgactcggcttttctttcttttccccttttctttctttatttgcttttttttttcctctcttcccttcttccacccatttccccctcctctttcttttgtttttttttagtcctccccccacccctcttctttcttttgttgctcgttcactctcgctcttgtctcctc

SEQ ID NO: 130821 - DNA, 30 bp, Homo sapiens; identical to SEQ ID NO: 101374
  misc_feature 1..30: note = chr9:97315453-97315483
  misc_feature 1..30: note = Hypo
  source 1..30: mol_type = genomic DNA

SEQ ID NO: 130822 - DNA, 341 bp, Homo sapiens; identical to SEQ ID NO: 101375
  misc_feature 1..341: note = chr9:97317331-97317672
  misc_feature 1..341: note = Hypo
  source 1..341: mol_type = genomic DNA

SEQ ID NO: 130823 - DNA, 30 bp, Homo sapiens; identical to SEQ ID NO: 101377
  misc_feature 1..30: note = chr9:97369352-97369382
  misc_feature 1..30: note = Hypo
  source 1..30: mol_type = genomic DNA

SEQ ID NO: 130824 - DNA, 88 bp, Homo sapiens; identical to SEQ ID NO: 101379
  misc_feature 1..88: note = chr9:97401378-97401466
  misc_feature 1..88: note = Hyper
  source 1..88: mol_type = genomic DNA

SEQ ID NO: 130825 - DNA, 386 bp, Homo sapiens; identical to SEQ ID NO: 101380
  misc_feature 1..386: note = chr9:97401694-97402080
  misc_feature 1..386: note = Hyper
  source 1..386: mol_type = genomic DNA

SEQ ID NO: 130826 - DNA, 30 bp, Homo sapiens; identical to SEQ ID NO: 101382
  misc_feature 1..30: note = chr9:97674944-97674974
  misc_feature 1..30: note = Hypo
  source 1..30: mol_type = genomic DNA

SEQ ID NO: 130827 - DNA, 139 bp, Homo sapiens; identical to SEQ ID NO: 101383
  misc_feature 1..139: note = chr9:97679482-97679621
  misc_feature 1..139: note = Hypo
  source 1..139: mol_type = genomic DNA

SEQ ID NO: 130828 - DNA, 30 bp, Homo sapiens; identical to SEQ ID NO: 101384
  misc_feature 1..30: note = chr9:97681851-97681881
  misc_feature 1..30: note = Hypo
  source 1..30: mol_type = genomic DNA

SEQ ID NO: 130829 - DNA, 90 bp, Homo sapiens; identical to SEQ ID NO: 101385
  misc_feature 1..90: note = chr9:97682129-97682219
  misc_feature 1..90: note = Hypo
  source 1..90: mol_type = genomic DNA

SEQ ID NO: 130830 - DNA, 176 bp, Homo sapiens; identical to SEQ ID NO: 101386
  misc_feature 1..176: note = chr9:97688199-97688375
  misc_feature 1..176: note = Hypo
  source 1..176: mol_type = genomic DNA

SEQ ID NO: 130831 - DNA, 200 bp, Homo sapiens; identical to SEQ ID NO: 101389
  misc_feature 1..200: note = chr9:97807628-97807828
  misc_feature 1..200: note = Hypo
  source 1..200: mol_type = genomic DNA

SEQ ID NO: 130832 - DNA, 30 bp, Homo sapiens; identical to SEQ ID NO: 42166
  misc_feature 1..30: note = chr9:97863868-97863898
  misc_feature 1..30: note = Hypo
  source 1..30: mol_type = genomic DNA

SEQ ID NO: 130833 - DNA, 171 bp, Homo sapiens; identical to SEQ ID NO: 101391
  misc_feature 1..171: note = chr9:97864916-97865087
  misc_feature 1..171: note = Hypo
  source 1..171: mol_type = genomic DNA

SEQ ID NO: 130834 - DNA, 30 bp, Homo sapiens; identical to SEQ ID NO: 101392
  misc_feature 1..30: note = chr9:97867526-97867556
  misc_feature 1..30: note = Hypo
  source 1..30: mol_type = genomic DNA

SEQ ID NO: 130835 - DNA, 30 bp, Homo sapiens; identical to SEQ ID NO: 101393
  misc_feature 1..30: note = chr9:97887305-97887335
  misc_feature 1..30: note = Hypo
  source 1..30: mol_type = genomic DNA

SEQ ID NO: 130836 - DNA, 62 bp, Homo sapiens; identical to SEQ ID NO: 101394
  misc_feature 1..62: note = chr9:97887619-97887681
  misc_feature 1..62: note = Hypo
  source 1..62: mol_type = genomic DNA

SEQ ID NO: 130837 - DNA, 30 bp, Homo sapiens; identical to SEQ ID NO: 101395
  misc_feature 1..30: note = chr9:97891726-97891756
  misc_feature 1..30: note = Hypo
  source 1..30: mol_type = genomic DNA

SEQ ID NO: 130838 - DNA, 44 bp, Homo sapiens; identical to SEQ ID NO: 101396
  misc_feature 1..44: note = chr9:98076575-98076619
  misc_feature 1..44: note = Hypo
  source 1..44: mol_type = genomic DNA

SEQ ID NO: 130839 - DNA, 1046 bp, Homo sapiens
  misc_feature 1..1046: note = chr9:98111349-98112395
  misc_feature 1..1046: note = Hyper
  source 1..1046: mol_type = genomic DNA
ctaccaggacacatgcgtaacggcctgtttgcgctccctgcggttacagccgacacacgctcgcagacgcacgcacggacaccccgctttccaccagcgcacgaagacgggacgcgcgctcacagccccagggctcggccctgcaccacgagctaacgcgcggtccccagggaggtggcgcagaaggcatggcgcctctgcccacggcgtcccggtcctggtagtccctatagagaccttcgttgatggcccaggtctaaaaggctttttcctccgagcctgcgttcctccagccttcccgctgggccagggctcaccatccttcctcgccggcgagcgtgggcctccctggaggcgggggtggccctgcagaggcagccccaggtgcgcgctggagaggccggcccgccgcgcgggagacactctttccaaagtggaagcgctgcgtgggcagcagcgcgggccgggccctcggatcccagtctctgttgctcccgagacccccgccccgcgccgcatcctccgagctcagcgccctcgggctgcgctgggcgcagtggctcccggtcagggcgcagtcggcctgggcgctagagcccctctcagctcccggcctagggcggggaagcgccagctcccgcagcccctgtgaaaggtcccctgtgcctcctgcctaggtgcgcgctgtggcatctctggccagaagcacctttggcggcctgttgggcccctcgcagcctctggctgagactctgccgccggcgctaacgggctgcgcccgcgctcccgctctgtccccgcccgggtcccgggctccgcgtgcacaccactccttggccttttccaccaaaacttcctgatctccagttcgatgctgtcgtcgcggttcccggaactgctgtcttcagacggcgagccggggctgggagcggccctcacggggacggactccctccggaggcggaggtggttctcctgacgcgaaaggcaggggcgcgccccggctcccagcgccctgtttttggaaaatacgattttgtagggtg

SEQ ID NO: 130840 - DNA, 25 bp, Homo sapiens
  misc_feature 1..25: note = chr9:98196381-98196406
  misc_feature 1..25: note = Hypo
  source 1..25: mol_type = genomic DNA
ccaccgcgcccggcctatgggctcc

SEQ ID NO: 130841 - DNA, 393 bp, Homo sapiens; identical to SEQ ID NO: 101402
  misc_feature 1..393: note = chr9:98277959-98278352
  misc_feature 1..393: note = Hyper
  source 1..393: mol_type = genomic DNA

SEQ ID NO: 130842 - DNA, 53 bp, Homo sapiens; identical to SEQ ID NO: 101403
  misc_feature 1..53: note = chr9:98278666-98278719
  misc_feature 1..53: note = Hyper
  source 1..53: mol_type = genomic DNA

SEQ ID NO: 130843 - DNA, 30 bp, Homo sapiens; identical to SEQ ID NO: 101404
  misc_feature 1..30: note = chr9:98279806-98279836
  misc_feature 1..30: note = Hyper
  source 1..30: mol_type = genomic DNA

SEQ ID NO: 130844 - DNA, 30 bp, Homo sapiens; identical to SEQ ID NO: 101405
  misc_feature 1..30: note = chr9:98315417-98315447
  misc_feature 1..30: note = Hyper
  source 1..30: mol_type = genomic DNA

SEQ ID NO: 130845 - DNA, 30 bp, Homo sapiens; identical to SEQ ID NO: 32577
  misc_feature 1..30: note = chr9:98315763-98315793
  misc_feature 1..30: note = Hyper
  source 1..30: mol_type = genomic DNA

SEQ ID NO: 130846 - DNA, 405 bp, Homo sapiens; identical to SEQ ID NO: 101407
  misc_feature 1..405: note = chr9:98783120-98783525
  misc_feature 1..405: note = Hyper
  source 1..405: mol_type = genomic DNA

SEQ ID NO: 130847 - DNA, 604 bp, Homo sapiens
  misc_feature 1..604: note = chr9:98783773-98784377
  misc_feature 1..604: note = Hyper
  source 1..604: mol_type = genomic DNA
gcggcctgggggacacggggcaaattctcggatagcgacgggcaggaaggggacccgggctggcgatgggccgagtgcctcctttgctctcacccccgcgcgaagacgaggccagtgggcgggtggcgtggggcgaggcctccgcaggccgccgggggcccaggcacctggagccgggagggtccgctcccttccccgccctggatggcggcctatgggaaagcagtctccactggatcccgcgcgcgtcgcgccgaggtcgtgggaaaccgagggcgggagggcgggagggcggaggcgccggcagggtcggcgggactggggctcggacggaggacaggggcgaggaggaggcaggaaggacgccgggtactgcggggcgcctagggggttccgagcgcagcggctgcggggccgacccgcccaggatggaatcagggccccggcgcccccacgccgctcctccaggccgaacccctgcggccccaatcccccggcctcacgcccaccccgcaggtcggccctgcagctgccttcccttcctccacctccctcccgcctccgaagccggcgcccccggccaagtggccgctctcaacctgtt

SEQ ID NO: 130848 - DNA, 155 bp, Homo sapiens; identical to SEQ ID NO: 101410
  misc_feature 1..155: note = chr9:98784772-98784927
  misc_feature 1..155: note = Hyper
  source 1..155: mol_type = genomic DNA

SEQ ID NO: 130849 - DNA, 551 bp, Homo sapiens
  misc_feature 1..551: note = chr9:98789547-98790098
  misc_feature 1..551: note = Hyper
  source 1..551: mol_type = genomic DNA
gtgtgctctagttcccggcaaagcaggtgggagacggagtgaccggcaggacaggctgcctggggaaccgggaaggctgaagtggacacaggaggagctggcagggagagcccaggccccgcgggctgcgggaaaggagagggcagcgactgggcgagggaggaaagaccctggccggggcagcccggcgcgggagaggctgcgtgtgcccggctcagtcacccgccctgggagaaggcggcccggttggaaagttgaggcggaaccgaaggcccccgcgtggaggctgcagcccctgcgccggccgggcgggtccggaaggagcccaggccgcacctccaggccggcgccgccgccgcccagcgcccacccgtccccccggcgccactccacatgcaccttctcccggggcgccgacggcctcggctgcccccgcagcgtttccctagcttccctccaaggcccccggccgctctttctcagcattcttcgcagcttcatctccatccgcgccgccttgccgagaccctccaagccgactcctcagcctt

SEQ ID NO: 130850 - DNA, 20 bp, Homo sapiens
  misc_feature 1..20: note = chr9:98793021-98793041
  misc_feature 1..20: note = Hypo
  source 1..20: mol_type = genomic DNA
aggtacgtggctccagcgac

SEQ ID NO: 130851 - DNA, 30 bp, Homo sapiens; identical to SEQ ID NO: 101414
  misc_feature 1..30: note = chr9:99189069-99189099
  misc_feature 1..30: note = Hypo
  source 1..30: mol_type = genomic DNA

SEQ ID NO: 130852 - DNA, 84 bp, Homo sapiens; identical to SEQ ID NO: 101415
  misc_feature 1..84: note = chr9:99380993-99381077
  misc_feature 1..84: note = Hyper
  source 1..84: mol_type = genomic DNA

SEQ ID NO: 130853 - DNA, 177 bp, Homo sapiens; identical to SEQ ID NO: 101416
  misc_feature 1..177: note = chr9:99381503-99381680
  misc_feature 1..177: note = Hyper
  source 1..177: mol_type = genomic DNA

SEQ ID NO: 130854 - DNA, 303 bp, Homo sapiens; identical to SEQ ID NO: 101417
  misc_feature 1..303: note = chr9:99449095-99449398
  misc_feature 1..303: note = Hyper
  source 1..303: mol_type = genomic DNA

SEQ ID NO: 130855 - DNA, 179 bp, Homo sapiens; identical to SEQ ID NO: 101418
  misc_feature 1..179: note = chr9:99487982-99488161
  misc_feature 1..179: note = Hypo
  source 1..179: mol_type = genomic DNA

SEQ ID NO: 130856 - DNA, 41 bp, Homo sapiens; identical to SEQ ID NO: 101419
  misc_feature 1..41: note = chr9:99539965-99540006
  misc_feature 1..41: note = Hyper
  source 1..41: mol_type = genomic DNA

SEQ ID NO: 130857 - DNA, 518 bp, Homo sapiens; identical to SEQ ID NO: 101420
  misc_feature 1..518: note = chr9:99639574-99640092
  misc_feature 1..518: note = Hyper
  source 1..518: mol_type = genomic DNA

SEQ ID NO: 130858 - DNA, 564 bp, Homo sapiens; identical to SEQ ID NO: 101422
  misc_feature 1..564: note = chr9:99983140-99983704
  misc_feature 1..564: note = Hyper
  source 1..564: mol_type = genomic DNA

SEQ ID NO: 130859 - DNA, 240 bp, Homo sapiens; identical to SEQ ID NO: 101423
  misc_feature 1..240: note = chr9:99983764-99984004
  misc_feature 1..240: note = Hyper
  source 1..240: mol_type = genomic DNA

SEQ ID NO: 130860 - DNA, 132 bp, Homo sapiens; identical to SEQ ID NO: 100071
  misc_feature 1..132: note = chr9:100000368-100000500
  misc_feature 1..132: note = Hyper
  source 1..132: mol_type = genomic DNA

SEQ ID NO: 130861 - DNA, 355 bp, Homo sapiens; identical to SEQ ID NO: 100072
  misc_feature 1..355: note = chr9:100000739-100001094
  misc_feature 1..355: note = Hyper
  source 1..355: mol_type = genomic DNA

SEQ ID NO: 130862 - DNA, 172 bp, Homo sapiens; identical to SEQ ID NO: 100073
  misc_feature 1..172: note = chr9:100264699-100264871
  misc_feature 1..172: note = Hyper
  source 1..172: mol_type = genomic DNA

SEQ ID NO: 130863 - DNA, 39 bp, Homo sapiens; identical to SEQ ID NO: 100074
  misc_feature 1..39: note = chr9:100267685-100267724
  misc_feature 1..39: note = Hypo
  source 1..39: mol_type = genomic DNA

SEQ ID NO: 130864 - DNA, 30 bp, Homo sapiens; identical to SEQ ID NO: 100075
  misc_feature 1..30: note = chr9:100278507-100278537
  misc_feature 1..30: note = Hypo
  source 1..30: mol_type = genomic DNA

SEQ ID NO: 130865 - DNA, 77 bp, Homo sapiens; identical to SEQ ID NO: 100076
  misc_feature 1..77: note = chr9:100349303-100349380
  misc_feature 1..77: note = Hypo
  source 1..77: mol_type = genomic DNA

SEQ ID NO: 130866 - DNA, 317 bp, Homo sapiens; identical to SEQ ID NO: 42169
  misc_feature 1..317: note = chr9:100397395-100397712
  misc_feature 1..317: note = Hypo
  source 1..317: mol_type = genomic DNA

SEQ ID NO: 130867 - DNA, 151 bp, Homo sapiens; identical to SEQ ID NO: 100078
  misc_feature 1..151: note = chr9:100457244-100457395
  misc_feature 1..151: note = Hypo
  source 1..151: mol_type = genomic DNA

SEQ ID NO: 130868 - DNA, 527 bp, Homo sapiens; identical to SEQ ID NO: 100079
  misc_feature 1..527: note = chr9:100503433-100503960
  misc_feature 1..527: note = Hyper
  source 1..527: mol_type = genomic DNA

SEQ ID NO: 130869 - DNA, 422 bp, Homo sapiens
  misc_feature 1..422: note = chr9:100610058-100610480
  misc_feature 1..422: note = Hyper
  source 1..422: mol_type = genomic DNA
tgggcaactggaacccggctggagtgtgcagctggccccctcacttccagcccgcaggctgccgcgggggtgactcccgggagatgcgcctagagaggcaggacacctgcacgcatattcgtaacagaggcagaaatactgacggcgaaacctagagagacttgcactccaggcccggggggtgggggggcgggggagaagccttagggagagtggggaggaggccagaggagagctggctgctctctcgtgttgaggttcaagtgtcttccagctccccgcgccccctcctcaccgtgccaccgcccacctcatgctttgggcgccaagcagccaagcaaccgggttgcgttgtagggggaggcaatcagccctgttacccctcctcaggcggccggactgagctgcgggatgggatccct

SEQ ID NO: 130870 - DNA, 982 bp, Homo sapiens
  misc_feature 1..982: note = chr9:100610681-100611663
  misc_feature 1..982: note = Hyper
  source 1..982: mol_type = genomic DNA
caagtgttccaaagccgcgcacaaatttcggaaccagaccaagaatcctggactctagacgttgcctgggggccgatcctgcgcccagggtcccagaatctaactgaaatgcgcctgcgggccgccaccttcgccccgggccacggctttgccaggaatgcccgccgccacagctgaactcccgcccgcccgcctgggtcggatcagacgcgggtagtggcttgcgcttcgtggtcctcgggtccggaacgcagggaaagcgcgtggagccaacctagagcgggagcagggtctggcttgactctgtccccgattcgttgtgcgcagtgggacaagtccgcgccgtccggagccgacttccccttctcgttgtggccgtaaagctgctggacctccaagccggctcctgcgctccccgctgctctgagaacactgagtgtcccgggcccgcgcagactgggttgggagagggctctgtgggagggcttgcggggagcggggtaagaaaggctaggtgcttcttacctacgtaagaaacgttggtggcgggatctaagcaaacggggaggtgggaagcagaaggttccccttcctgggccccagttcctccatcctgtcccctgggtgacagtgattcgctgttcatagtgtttaagtggaccaacttaaagggagagagcgcttgccgagctctgggaaaccgaaagggtccacgcccgcgggagcctcggagactcaaaatcccccgctagaccgcagaaaatgttacactttaatcaaccgctacttcttccgtggagaggggcggtgggtgggggtgtgcgcatctcatcgcggcctgtgagtggaacaggctagaattatccccagcgtcttttttccatgtccaagtttcgccttaaaacaatttaaaagaggaagaagaggaccgcgcgtctgtaaggcgctccactttatcaccttgactcggtggaagagaaag

SEQ ID NO: 130871 - DNA, 4368 bp, Homo sapiens
  misc_feature 1..4368: note = chr9:100613687-100618055
  misc_feature 1..4368: note = Hyper
  source 1..4368: mol_type = genomic DNA
cgttaggacaacggtcgtccagaatttaaaatctagatatctgaatctcagaatcttgaaagttactgagagccacgaaatcccgtattaaaaggtgcctataatataatccagttaaaaattttaaaatttgaagtttttcctcctttgtaaaaacgaaacaggacgaaatctgggttttttgcttctccattacttgggaagaaggaaaccaggagttttgtttagcgagtgtaaagcccctctcccttcgttcgaccaaccctctgccgcagaaggttgtcaagcaaacgctttgagcgtttccacacaccgggtcgacggagcaaggatctgggctttgcctcgctcttccgaaggcagctgcccaacgcttggccgggcttagcctgccctcagctcaccgccacgaagaacgcgactaaaaccctggaaggcatgccacccgttactggccagaactctcgtcttgggatctcccacactcacctggcaccaccatccgcgcggctctgcacccacagccccggcccgccccccccccccaccccggaaagctgcgtccgggctggagccactggaacccgcgccaaggcccggaatcctatacgtagcaggggcctcggagatcagcacacgccctccagctgctatttaacagagtagaacactgaggccctgcgaggggacaaggacaggccctggatctcccagtgaatggccagggaacgaacccgggccagaggggccgcgccgcgaggatctcaggttaggaccaagttccggctcagggacagcaggaaaggaactcagaaattggacacccatgaagcaaacgtgtcccgactgcccgccccttcccccggagacgcgcccacccggccaccgctctcttcccactcccccattacccgcagccctcactccccgctgcgggaaggggctgcttggctgcctctgggggtcttcagagctaccctggtcccgggggattggaggaggaggttacctatcctgcgtcgtctttaatccgtgcaccactatccatcaaatagagacagatcctgggcctctcaaagacggatgattgggggtggtgattggcctatccctaaatatctaccacgcaaggactcttgagagatccagaccccggtacagtcgagggacctggggcccaaaaagggaaagcggctacctctaccacacagttgggaagcgcagtcctaaaggagacgcaggttggagactccgctaagcggagaagccgcagtggggccatggcaagtcaccttccctttcgggcctaggaatactcattcgaaagatggggggactggagtgccgagtggctgtggcagccacgattggggtttggaaaccatcctgaaaggcccggggagccagtctcctggaacttctccctccccattcccacaaaaaccaagcgccctctcggccaattctcaccctctcaggacaaaaaagtgagatgagcccgtcctttcacctgcgagtccaagcccttggcagaggcctgaaaagtccgaaaactccgagttcgggcgctgaggtctcccgagccggttcctgaactctccgggcctcagtcgatcggggtgcggagggggccgacccgggggatctccaagcgccctccccgccctgacgctgtggggctcctaccgcgccgccacagctgctcctacctggggaggtgcgcccgggccccggggggcgggcagtcggggggcgggcagggaaccggtgccgccccacgcttcgtggcccctttaaggaggggaagccggcggagggaggagccggtccggtgtgtgcaggggagcgcctcgccagcggtccgcagggctggagacccacgccgtggagaggaccagcctcaggtcgccccgcctgggcccgcgccccgacctcgctgcccccgcctcgcctctctgcccgtggcgcttacggccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtcccggtcacgaggccaccgccgctgcccgcctcgagaagcaccacgcgggctgagccgtcggctagcgggtcactcccgagcctctgtctgcaccgcgccagccccagaccacggacgctgagcctccagcgcgtgccagcctgggccgctgggctctcggggccagcccgcgacgatcccctgagctctccgcagaagggccgagcgtccgttccggggacgccaggcccgcccccgccccccgacagccgcggggatccagagcccgggggtgcgggacgcccgcgccatgactgccgagagcgggccgccgccgccgcagccggaggtgctggctaccgtgaaggaagagcgcggcgagacggcagcaggggccggggtcccaggggaggccacgggccgcggggcgggcgggcggcgccgcaagcgccccctgcagcgcgggaagccgccctacagctacatcgcgctcatcgccatggccatcgcgcacgcgcccgagcgccgcctcacgctgggcggcatctacaagttcatcaccgagcgcttccccttctaccgcgacaaccccaaaaagtggcagaacagcatccgccacaacctcacactcaacgactgcttcctcaagatcccgcgcgaggccggccgcccgggtaagggcaactactgggcgcttgaccccaacgcggaggacatgttcgagagcggcagcttcctgcgccgccgcaagcgcttcaagcgctcggacctctccacctacccggcttacatgcacgacgcggcggctgccgcagccgccgccgccgccgccgccgccgccgccgccatcttcccaggcgcggtgcccgccgcgcgccccccctacccgggcgccgtctatgcaggctacgcgccgccgtcgctggccgcgccgcctccagtctactaccccgcggcgtcgcccggcccttgccgcgtcttcggcctggttcctgagcggccgctcagcccagagctggggcccgcaccgtcggggcccggcggctcttgcgcctttgcctccgccggcgcccccgctaccaccaccggctaccagcccgcaggctgcaccggggcccggccggccaacccctccgcctatgcggctgcctacgcgggccccgacggcgcgtacccgcagggcgccggcagtgcgatctttgccgctgctggccgcctggcgggacccgcttcgcccccagcgggcggcagcagtggcggcgtggagaccacggtggacttctacgggcgcacgtcgcccggccagttcggagcgctgggagcctgctacaaccctggcgggcagctcggaggggccagtgcaggcgcctaccatgctcgccatgctgccgcttatcccggtgggatagatcggttcgtgtccgccatgtgagccagcgtagggacgaaaactcatagacacatcggctgttcacacgttccccgcaatctgagaacgaacaggaatggagagaggactcaactgggacccacgtggaaaagaccgagcaggccacagaggctcggtctccccgcgcacagcgtaggcacccggtgtactctgtaaacgggaggaggtggggcgaggcagccagagcccttggactggcacagggaccctcgatggagcgaagccctcaaacgggatgctttctggtattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttcttaaagtgaggaggacaaatttgcaaaagaaataggcttttcttcttttttaaattggagaaatctctgctctggttgacctgggctggttttccctgtctctgagaacttgagacctagctccgagttgaactgtgcgtcagcactccagtcccatcacctgaaccttcagtctcccccatctgttacactagagggctgcaggactctatccaccgcccccgggttatcattcagggccccatcatcttggatgctgccctgcgtatttggcagcaa

SEQ ID NO: 130872 - DNA, 1163 bp, Homo sapiens; identical to SEQ ID NO: 32603
  misc_feature 1..1163: note = chr9:100619620-100620783
  misc_feature 1..1163: note = Hyper
  source 1..1163: mol_type = genomic DNA

SEQ ID NO: 130873 - DNA, 17 bp, Homo sapiens
  misc_feature 1..17: note = chr9:100735117-100735134
  misc_feature 1..17: note = Hypo
  source 1..17: mol_type = genomic DNA
tgcggcactgcactcca

SEQ ID NO: 130874 - DNA, 30 bp, Homo sapiens; identical to SEQ ID NO: 100092
  misc_feature 1..30: note = chr9:100797208-100797238
  misc_feature 1..30: note = Hyper
  source 1..30: mol_type = genomic DNA

SEQ ID NO: 130875 - DNA, 52 bp, Homo sapiens; identical to SEQ ID NO: 100093
  misc_feature 1..52: note = chr9:100817046-100817098
  misc_feature 1..52: note = Hypo
  source 1..52: mol_type = genomic DNA

SEQ ID NO: 130876 - DNA, 143 bp, Homo sapiens; identical to SEQ ID NO: 100094
  misc_feature 1..143: note = chr9:100818294-100818437
  misc_feature 1..143: note = Hypo
  source 1..143: mol_type = genomic DNA

SEQ ID NO: 130877 - DNA, 21 bp, Homo sapiens
  misc_feature 1..21: note = chr9:100835849-100835870
  misc_feature 1..21: note = Hypo
  source 1..21: mol_type = genomic DNA
ccaccgcgcctggcctgggct

SEQ ID NO: 130878 - DNA, 124 bp, Homo sapiens; identical to SEQ ID NO: 100096
  misc_feature 1..124: note = chr9:100843289-100843413
  misc_feature 1..124: note = Hypo
  source 1..124: mol_type = genomic DNA

SEQ ID NO: 130879 - DNA, 176 bp, Homo sapiens; identical to SEQ ID NO: 100097
  misc_feature 1..176: note = chr9:100935510-100935686
  misc_feature 1..176: note = Hypo
  source 1..176: mol_type = genomic DNA

SEQ ID NO: 130880 - DNA, 30 bp, Homo sapiens; identical to SEQ ID NO: 42172
  misc_feature 1..30: note = chr9:100981193-100981223
  misc_feature 1..30: note = Hypo
  source 1..30: mol_type = genomic DNA

SEQ ID NO: 130881 - DNA, 94 bp, Homo sapiens; identical to SEQ ID NO: 42173
  misc_feature 1..94: note = chr9:100981840-100981934
  misc_feature 1..94: note = Hypo
  source 1..94: mol_type = genomic DNA

SEQ ID NO: 130882 - DNA, 30 bp, Homo sapiens; identical to SEQ ID NO: 100100
  misc_feature 1..30: note = chr9:101016284-101016314
  misc_feature 1..30: note = Hypo
  source 1..30: mol_type = genomic DNA

SEQ ID NO: 130883 - DNA, 38 bp, Homo sapiens; identical to SEQ ID NO: 100101
  misc_feature 1..38: note = chr9:101216438-101216476
  misc_feature 1..38: note = Hypo
  source 1..38: mol_type = genomic DNA

SEQ ID NO: 130884 - DNA, 1179 bp, Homo sapiens; identical to SEQ ID NO: 100102
  misc_feature 1..1179: note = chr9:101469181-101470360
  misc_feature 1..1179: note = Hyper
  source 1..1179: mol_type = genomic DNA

SEQ ID NO: 130885 - DNA, 1346 bp, Homo sapiens
  misc_feature 1..1346: note = chr9:101470607-101471953
  misc_feature 1..1346: note = Hyper
  source 1..1346: mol_type = genomic DNA
gatctgaccaaaggccggaggttgcctgtgtccaaaccacccaccccaatgccccccgaagccccgacggcaggggcagccggacactcacctccgtgtcatagagccgcaggtcgaggaagtaggggcgcaggagtgactcgttgcggatctgctcgatggccagttccacggcggggagcacaccgcgcccgatgctgcccttggccacctccttggtgagcggcatgaggcccatgatggagagcggcgggctgctgggcggcggccggggggcgccccgcgcccagccccaggccccgggcgccagaggcagcagcagcggcagcagcagtagcagtagcaggcgcgcgggcggcggtggcggcggcggcggcggcccgggctgcccggagctccgcggggaagccatgccgcgccgcgggctgcgggcgccggctcactcggcccgcatggcctggcccggcccgccgccccgcgccaaggtcttcccgcggcgcccgcgcaatggcgccggcccgggccccggctccgtctcgggctagggttccggctcggctcagaacggccgcggcggcggcggcggcagcggcggcgcccgtgacggatcaatcacgccgggaaggggtgggagcgagcggagtgcgggaggcggggagcaagcgagcaaacgcggagaggggggccggcgtctccgcgcgcgcctctctccagcgcggccgccccgcaccgggccgcctccgcccgcccccgtgcgcgctctgaaccgctctcccgccgggagctgctaggcggcagcccctggagctcggccgggggagggcggacggcaggaaacgcgggaggcgaaggcgaggctgctcaggggcggctcgggccgcctccagggacggggacgagccgtgcgcgccgggggagggggaggcgctggcgctgcggcggccgcggggagggccaccttcccagcacacgcacacacgcgcccccggccctccgctgcgccagctgccgctgcccgccgaccgctgacctccaggcaccagagcgcccggggacagcgatctgggaaccgggaccgcgcgctggcacacgcagtggccgccgccgctccgccgagcgctgcctgtagcacctgcacggtggtttggaaccgcttctcggaggtctggccgggaaggtctgggcaggagaatgttccacgaaggcgtcccagaggcatctgcagcctacgctctcccgttcttttctggcgcccacgagcccctgaccgagtcccgggggtcgctgaagacgcccacgggtgctcgaacgcccgttggtgccaggctgcccggcctttagggcct

SEQ ID NO: 130886 - DNA, 30 bp, Homo sapiens; identical to SEQ ID NO: 42174
  misc_feature 1..30: note = chr9:101557939-101557969
  misc_feature 1..30: note = Hypo
  source 1..30: mol_type = genomic DNA

SEQ ID NO: 130887 - DNA, 49 bp, Homo sapiens; identical to SEQ ID NO: 100106
  misc_feature 1..49: note = chr9:101559178-101559227
  misc_feature 1..49: note = Hyper
  source 1..49: mol_type = genomic DNA

SEQ ID NO: 130888 - DNA, 1028 bp, Homo sapiens
  misc_feature 1..1028: note = chr9:101705868-101706896
  misc_feature 1..1028: note = Hyper
  source 1..1028: mol_type = genomic DNA
agaggattccctcagcggctgtgaaagagtgctttcttgcgggtcagccccgacaggacagacttaagggcgggagggagcccatcccgcttgccccaacgaacgcgggcgcggggctttcctcgcaggttacataaggcagccgcgggtggaggcagcagaggcgagcgcacgtccgtcgagggggaaaggggcgtggggaggcggccggggcggccggtatcccccgggcgtgagtgcgcagcgcgcgggggagcgcagggcgcggcggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggtaagacccgcttctctgcttcctcgcgtcccgggcccctccaatactcttgcccgcctcaccttttctccctcgggcacatcttgcaggaggaacaacgggcagtgctggtgtctgctgatgctgctctcggtctccacgcccctccctgctgtcacccagacccgcggtgcgacaggtaagcaacccggtcggagggtggcaccggctgcctccgcgcccgtgggggaagtcggttttggcggcggacgcggctgcgatgcgtgcctcattcctggacataaaagggagtcttgccactcagtgcgcactggcggtcccgcgggcggctacctcctggcagtgcaggggttatagctgtgaatgggatccctgggcagctggggcggttggagcgttgtctgggcacccgagatgtctgagctgggtgcggagcctccaatcttaggcagagagggacttcagaaacagcgccagcgccagcgccaacagcctcagcgcacccagcgccagcagcttaggttgtgcgtgctggctggctt

SEQ ID NO: 130889 - DNA, 30 bp, Homo sapiens; identical to SEQ ID NO: 100110
  misc_feature 1..30: note = chr9:101734127-101734157
  misc_feature 1..30: note = Hypo
  source 1..30: mol_type = genomic DNA

SEQ ID NO: 130890 - DNA, 30 bp, Homo sapiens; identical to SEQ ID NO: 100111
  misc_feature 1..30: note = chr9:101924520-101924550
  misc_feature 1..30: note = Hypo
  source 1..30: mol_type = genomic DNA

SEQ ID NO: 130891 - DNA, 19 bp, Homo sapiens
  misc_feature 1..19: note = chr9:101982656-101982675
  misc_feature 1..19: note = Hypo
  source 1..19: mol_type = genomic DNA
tacataagaatgtcccggc

SEQ ID NO: 130892 - DNA, 40 bp, Homo sapiens; identical to SEQ ID NO: 100113
  misc_feature 1..40: note = chr9:102107331-102107371
  misc_feature 1..40: note = Hypo
  source 1..40: mol_type = genomic DNA

SEQ ID NO: 130893 - DNA, 30 bp, Homo sapiens; identical to SEQ ID NO: 100114
  misc_feature 1..30: note = chr9:102186087-102186117
  misc_feature 1..30: note = Hypo
  source 1..30: mol_type = genomic DNA

SEQ ID NO: 130894 - DNA, 28 bp, Homo sapiens
  misc_feature 1..28: note = chr9:102203901-102203929
  misc_feature 1..28: note = Hypo
  source 1..28: mol_type = genomic DNA
gcatgagccactgcgcccagcctattcc

SEQ ID NO: 130895 - DNA, 341 bp, Homo sapiens; identical to SEQ ID NO: 100116
  misc_feature 1..341: note = chr9:102586644-102586985
  misc_feature 1..341: note = Hyper
  source 1..341: mol_type = genomic DNA

SEQ ID NO: 130896 - DNA, 37 bp, Homo sapiens; identical to SEQ ID NO: 15233
  misc_feature 1..37: note = chr9:103174717-103174754
  misc_feature 1..37: note = Hypo
  source 1..37: mol_type = genomic DNA

SEQ ID NO: 130897 - DNA, 87 bp, Homo sapiens; identical to SEQ ID NO: 100118
  misc_feature 1..87: note = chr9:103176794-103176881
  misc_feature 1..87: note = Hypo
  source 1..87: mol_type = genomic DNA

SEQ ID NO: 130898 - DNA, 722 bp, Homo sapiens
  misc_feature 1..722: note = chr9:103235208-103235930
  misc_feature 1..722: note = Hyper
  source 1..722: mol_type = genomic DNA
caaacaagtctgctacggtgcagcctaccgccgaggggtggccccaaccccggcccccgcgcccctgccctgtcgcaggaacaatagctcccctggaggcggcgccggccgcggccgggggcggagctgtcggcgcgggagctgggggtgtgcgcggggcggggtcgcagccacccctcccgccggcggctccgtcacgcgcccctcaccgggcgggccggggtctttgtgacgcggtggcaacggccacggacacaaagggaaggcgaggaggcgagcaagaggctgggcctgcctccggcccgcgacccccgcccgccgcgcgcgcgcccgcccgctcccctcgccgcggtgtcccccacgccggctcgcaccctcgcgcgcacccttgcgcgcccgcgaccctcgcacgcgcccggacccgccgactccgtcccgagcgccgcgggcccgggcctggcggacgctgcgggtggggcggggatgctgacgggctgctccccggctcagcggcgcggctgctaggaggcaccgaggcagcggcggggctctgggcgcgcggctggatgcccccggcctgcggctccctgcgcttcccgccgtccaggggcaccagtcatgggcgccgcagccgctgaggcgccgctccggctgcctgccgcgcctccgctcgccttctgctgctacacgtcggtgcttctgctcttcgccttctctctgcc

SEQ ID NO: 130899 - DNA, 42 bp, Homo sapiens; identical to SEQ ID NO: 100121
  misc_feature 1..42: note = chr9:103236598-103236640
  misc_feature 1..42: note = Hyper
  source 1..42: mol_type = genomic DNA

SEQ ID NO: 130900 - DNA, 137 bp, Homo sapiens; identical to SEQ ID NO: 32616
  misc_feature 1..137: note = chr9:103790552-103790689
  misc_feature 1..137: note = Hyper
  source 1..137: mol_type = genomic DNA

SEQ ID NO: 130901 - DNA, 55 bp, Homo sapiens; identical to SEQ ID NO: 100123
  misc_feature 1..55: note = chr9:103790962-103791017
  misc_feature 1..55: note = Hyper
  source 1..55: mol_type = genomic DNA

SEQ ID NO: 130902 - DNA, 484 bp, Homo sapiens; identical to SEQ ID NO: 100124
  misc_feature 1..484: note = chr9:103791220-103791704
  misc_feature 1..484: note = Hyper
  source 1..484: mol_type = genomic DNA

SEQ ID NO: 130903 - DNA, 151 bp, Homo sapiens; identical to SEQ ID NO: 100125
  misc_feature 1..151: note = chr9:103791929-103792080
  misc_feature 1..151: note = Hyper
  source 1..151: mol_type = genomic DNA

SEQ ID NO: 130904 - DNA, 332 bp, Homo sapiens; identical to SEQ ID NO: 100127
  misc_feature 1..332: note = chr9:104248291-104248623
  misc_feature 1..332: note = Hyper
  source 1..332: mol_type = genomic DNA

SEQ ID NO: 130905 - DNA, 130 bp, Homo sapiens; identical to SEQ ID NO: 100128
  misc_feature 1..130: note = chr9:104248845-104248975
  misc_feature 1..130: note = Hyper
  source 1..130: mol_type = genomic DNA

SEQ ID NO: 130906 - DNA, 75 bp, Homo sapiens; identical to SEQ ID NO: 100129
  misc_feature 1..75: note = chr9:104249474-104249549
  misc_feature 1..75: note = Hyper
  source 1..75: mol_type = genomic DNA

SEQ ID NO: 130907 - DNA, 1302 bp, Homo sapiens
  misc_feature 1..1302: note = chr9:104499922-104501224
  misc_feature 1..1302: note = Hyper
  source 1..1302: mol_type = genomic DNA
gggcttacgggagcccggcggcccccggccatgcagggtgctccccaaccagcgtgcgcccggcgagggcgccggggaccgcctagtccctggctccggctcatccctctgggctcctgctcggctgtcgtccggagcgcggctggccgcgcggggggcggtggtccagggctgcaagtgcaccgcgcccaccctcaccgcgtgcccgatgcgcttgaggatctggcagggctgcgggtgcgaggaggagctgggcaccccggccagcaccagtgcgcagggcggcggcaacagcagacagaccctgctcagcagccaccacaaactcagtctcctcattactgagacccgcagggagaaagcgcgccccctcctgcgcccggctcgcccctctgcagccgctgcctgaggtctccgcctccaggtcccgcgcgcagcttcactccactcggtgaagcggtcccaggagctggagcggtctctaggccatgcaagttggagcgtagcgcgcctccggcagtctcagatcccgctcccaggtccctccgcctggcatcctctgcccgcccggtcactgcgctgagcaggcaggcgggcgggccggcgcctgtcacccgcagctggagcgcccgttccctgcccgccccatctgcagggcgcctcgggcactgcgtccggccccgcgaggcggccgggatgagaagcagccggagttcctcgggggcagcagtgacagaggagcgacgcgctctcgcctggattcttttccttttctgcccaggcgagacccacttatttcctggggtcgcgttggagagggctttcacgcccggggtgcggaaaagaagccaaatccaccttcctccactgttggccaccctcctgcaggctcccccagcgccgacttcattttctctcttctctcgctacttcctctctgcctttctttcgttatttttccaccgagtcgccaccgccgcttgcttcctcggaggagcaacgcgactggccagcaaagggtggctctgctccgagcgccaaagttctccccgcctcagccggcgcctccctgttgctgagccctggcgcctgcctgtcgcttggctgcgctaaacgcccactgttggtgagattcccgagtggcacatcccgcgcccctggaaagtcctctcccctcaaaggctgggcgtcatagtttgcaaaattccctaaaacctaagaaggaaaataggactatgagccggtgagaattctgaattcagagtcgcacctgagggatctgaaattcggtggttcactgaa

SEQ ID NO: 130908 - DNA, 19 bp, Homo sapiens
  misc_feature 1..19: note = chr9:105418502-105418521
  misc_feature 1..19: note = Hypo
  source 1..19: mol_type = genomic DNA
ttatttattttgagacgga

SEQ ID NO: 130909 - DNA, 196 bp, Homo sapiens; identical to SEQ ID NO: 42179
  misc_feature 1..196: note = chr9:107221358-107221554
  misc_feature 1..196: note = Hypo
  source 1..196: mol_type = genomic DNA

SEQ ID NO: 130910 - DNA, 108 bp, Homo sapiens; identical to SEQ ID NO: 100140
  misc_feature 1..108: note = chr9:107396386-107396494
  misc_feature 1..108: note = Hypo
  source 1..108: mol_type = genomic DNA

SEQ ID NO: 130911 - DNA, 30 bp, Homo sapiens; identical to SEQ ID NO: 100141
  misc_feature 1..30: note = chr9:107526267-107526297
  misc_feature 1..30: note = Hyper
  source 1..30: mol_type = genomic DNA

SEQ ID NO: 130912 - DNA, 332 bp, Homo sapiens; identical to SEQ ID NO: 100142
  misc_feature 1..332: note = chr9:107730465-107730797
  misc_feature 1..332: note = Hyper
  source 1..332: mol_type = genomic DNA

SEQ ID NO: 130913 - DNA, 476 bp, Homo sapiens; identical to SEQ ID NO: 32627
  misc_feature 1..476: note = chr9:108418471-108418947
  misc_feature 1..476: note = Hyper
  source 1..476: mol_type = genomic DNA

SEQ ID NO: 130914 - DNA, 30 bp, Homo sapiens; identical to SEQ ID NO: 100144
  misc_feature 1..30: note = chr9:109012750-109012780
  misc_feature 1..30: note = Hypo
  source 1..30: mol_type = genomic DNA

SEQ ID NO: 130915 - DNA, 607 bp, Homo sapiens; identical to SEQ ID NO: 100145
  misc_feature 1..607: note = chr9:109622609-109623216
  misc_feature 1..607: note = Hyper
  source 1..607: mol_type = genomic DNA

SEQ ID NO: 130916 - DNA, 194 bp, Homo sapiens; identical to SEQ ID NO: 100146
  misc_feature 1..194: note = chr9:109623464-109623658
  misc_feature 1..194: note = Hyper
  source 1..194: mol_type = genomic DNA

SEQ ID NO: 130917 - DNA, 102 bp, Homo sapiens; identical to SEQ ID NO: 100147
  misc_feature 1..102: note = chr9:109624462-109624564
  misc_feature 1..102: note = Hyper
  source 1..102: mol_type = genomic DNA

SEQ ID NO: 130918 - DNA, 30 bp, Homo sapiens; identical to SEQ ID NO: 100148
  misc_feature 1..30: note = chr9:110126233-110126263
  misc_feature 1..30: note = Hypo
  source 1..30: mol_type = genomic DNA

SEQ ID NO: 130919 - DNA, 847 bp, Homo sapiens; identical to SEQ ID NO: 100149
  misc_feature 1..847: note = chr9:110227815-110228662
  misc_feature 1..847: note = Hyper
  source 1..847: mol_type = genomic DNA

SEQ ID NO: 130920 - DNA, 30 bp, Homo sapiens; identical to SEQ ID NO: 100150
  misc_feature 1..30: note = chr9:110251099-110251129
  misc_feature 1..30: note = Hyper
  source 1..30: mol_type = genomic DNA

SEQ ID NO: 130921 - DNA, 616 bp, Homo sapiens; identical to SEQ ID NO: 100151
  misc_feature 1..616: note = chr9:110251462-110252078
  misc_feature 1..616: note = Hyper
  source 1..616: mol_type = genomic DNA

SEQ ID NO: 130922 - DNA, 74 bp, Homo sapiens; identical to SEQ ID NO: 100152
  misc_feature 1..74: note = chr9:110252298-110252372
  misc_feature 1..74: note = Hyper
  source 1..74: mol_type = genomic DNA

SEQ ID NO: 130923 - DNA, 67 bp, Homo sapiens; identical to SEQ ID NO: 100153
  misc_feature 1..67: note = chr9:110252633-110252700
  misc_feature 1..67: note = Hyper
  source 1..67: mol_type = genomic DNA

SEQ ID NO: 130924 - DNA, 223 bp, Homo sapiens; identical to SEQ ID NO: 100154
  misc_feature 1..223: note = chr9:110253522-110253745
  misc_feature 1..223: note = Hyper
  source 1..223: mol_type = genomic DNA

SEQ ID NO: 130925 - DNA, 627 bp, Homo sapiens; identical to SEQ ID NO: 100155
  misc_feature 1..627: note = chr9:110399878-110400505
  misc_feature 1..627: note = Hyper
  source 1..627: mol_type = genomic DNA

SEQ ID NO: 130926 - DNA, 464 bp, Homo sapiens
  misc_feature 1..464: note = chr9:111929136-111929600
  misc_feature 1..464: note = Hyper
  source 1..464: mol_type = genomic DNA
cccggtctcccctcccgcaacccctcgccctcccgcagcctcaccctcctccgacaggtagcgcaggtcgtagaactcccccgcgaaggtgccgtaggaggagtcgtggcgcggcaccgcctcgtcggcgcccgtgtccccccgcgcgcgtccccggggtccccggccccccgggcccgcaccgtcgtccgcggggctggctgcgcaggcggcgggccccgtcagtagcagcaggagcagcgacgcccagacccccgggtgctgccggggcggccgcgccatccgtgcgcacagatcccgcagccaggccgctcgggccgcagcgggggcgccgcgggcgcgggccgggactgagcctccgccgaggccaccagcacgcgcccgcgcagccgcggagcctcccgcacccccgcctccctgcctcggtctgcgcatcctcgctccagcaccgcagcctccccctt

SEQ ID NO: 130927 - DNA, 80 bp, Homo sapiens; identical to SEQ ID NO: 32639
  misc_feature 1..80: note = chr9:112081693-112081773
  misc_feature 1..80: note = Hyper
  source 1..80: mol_type = genomic DNA

SEQ ID NO: 130928 - DNA, 427 bp, Homo sapiens; identical to SEQ ID NO: 100161
  misc_feature 1..427: note = chr9:112259825-112260252
  misc_feature 1..427: note = Hyper
  source 1..427: mol_type = genomic DNA

SEQ ID NO: 130929 - DNA, 55 bp, Homo sapiens; identical to SEQ ID NO: 100162
  misc_feature 1..55: note = chr9:112260468-112260523
  misc_feature 1..55: note = Hyper
  source 1..55: mol_type = genomic DNA

SEQ ID NO: 130930 - DNA, 54 bp, Homo sapiens; identical to SEQ ID NO: 100163
  misc_feature 1..54: note = chr9:112261948-112262002
  misc_feature 1..54: note = Hyper
  source 1..54: mol_type = genomic DNA

SEQ ID NO: 130931 - DNA, 988 bp, Homo sapiens
  misc_feature 1..988: note = chr9:112402499-112403487
  misc_feature 1..988: note = Hyper
  source 1..988: mol_type = genomic DNA
aacgccgcattaaggcgcttcaagatagctggagttttgcttgggaaactcagagggatctcgcccggccggcacaatggcgtttctgaacccatgcccagcccactgggggcagtccttgctgcttgcagaggccagacgcttcttgcaacttctaagcggcgagagctgccaccttgccaatgactcaaccgtttgcctatgccctctgggctgtgccaccagccgcagccgccctgctcccccacccacccttctccccaggctccgcgccgcgccgccagtcccaggggagccgccggcgcacctggcgcctagggcgcacggcactgcgcgctggtgggcacctcacccgacgccagctgccagcgcgctccctccccgaaaccctgaagtggggtgtcttgtctagcgcccagcgaacaacattatccaattgcttcccgttttattcgcaggctgggagctgagagagcctgagcattcactttcaaccctccaggggaggagggggtgcgggtggggaggggagacggctcccagctccacctcgcgcgcggcgcggccagtgcactcggctccgggagaggcgagcagcgccggtgagccccgcagcagcgcacccggccgcggagccccgcgatggagtgagtatccccgagccgcgccgccagctgctctcctctcggcatgttgccatggtgaccgcggcggcaggcagatcccgctcgggtccgcgtccaggatgggtgtttaatttcagccccgtgtgtacgcctggtgtttctatagcagccgccgcggcggcaggaggcaaggggtgggagccccgggtggcgtggtttttgcggctgccccttggctagcagggcctggggggcgagtgaggggagtagatgatgttgctaaggacggaggcatattctaggctttcctatctctgccccaagcttccgcttatcggggagttggccgcaatagccatgac

SEQ ID NO: 130932 - DNA, 688 bp, Homo sapiens; identical to SEQ ID NO: 100166
  misc_feature 1..688: note = chr9:112542235-112542923
  misc_feature 1..688: note = Hyper
  source 1..688: mol_type = genomic DNA

SEQ ID NO: 130933 - DNA, 30 bp, Homo sapiens; identical to SEQ ID NO: 100167
  misc_feature 1..30: note = chr9:112806909-112806939
  misc_feature 1..30: note = Hypo
  source 1..30: mol_type = genomic DNA

SEQ ID NO: 130934 - DNA, 1265 bp, Homo sapiens
  misc_feature 1..1265: note = chr9:113341075-113342340
  misc_feature 1..1265: note = Hyper
  source 1..1265: mol_type = genomic DNA
tgacatccctctaagcgttttaaaatccattatcccattggaacctccacaacaataataggcgggtagcgatgactctggttttgtggatggggacgcttgacttggggtggttatgccttgcccaggactgaaccccgggatagagacgggcaggcagcggtgggtcgaagggcccggggactagggcccgggtcgggaggggcgggcgccttaccgcggcttgctggaaggcgcccttggtgtaggtgccgccacctcggtaggagatggcagggatctcttggaggagcagcgcgcacttgtgctggcgcgcgcggcgggtggagatgtaatcgacgcgcggcaccacgtagttcttggacgagaaggtcacgatggccacgcgcgtggccgtgggcaccacggggaagtcggacagcagcttgcggacgaacatgagctcgctgcggaagttgacttcgcccacgctggacgaatcatccaccaggaagacaagctccaggcgctcgctgagctcccgcagcagccgcacgcgtcgccggaacgcctggcccagccgctccactctgctccccgccgcttcgtcgccaggagcgggcggcgcggggatactcccgggggccccgggcgcggtctcggggaagaggcggaagctgaaattgcgcgacggggacatctgctgaaaggtcgcccagcccgaaacgagcgccagaccccagcaacaaaaggccaggcgaggccacatcgcgctggagacagagcggctgccccggagcgcaggcggcggctcgggcgggaagaggcgctgggcggccggactcgcagaggggcgtgcgcggagctgggcgcggggcagcggccaagagcctcagcgccctttcatctgacactggggacagacacaatccagactcctcagcagctcgggaactccggagggaacggcgcgcgctctctacccctctcgctctcctctttttttcttccctctctcctcctcctctctctccctgaagcctataaaatgtttgaaggaaagggggcagtcaagaaaaatctcccgcttccctccttctctccctctctccctctccccgctcctgtctactttctgtatctgtgactctatctccctcctccccctctcattctcctcccgggatcaagccaaaggctcggagattccatgacaccagaaccccgcgtctgtcaggctgtcaacattcccgcagcaagcgcaccagcgccgaagccctgattga

SEQ ID NO: 130935 - DNA, 18 bp, Homo sapiens
  misc_feature 1..18: note = chr9:113366336-113366354
  misc_feature 1..18: note = Hypo
  source 1..18: mol_type = genomic DNA
gcccggtcataattccct

SEQ ID NO: 130936 - DNA, 30 bp, Homo sapiens; identical to SEQ ID NO: 100174
  misc_feature 1..30: note = chr9:113689346-113689376
  misc_feature 1..30: note = Hypo
  source 1..30: mol_type = genomic DNA

SEQ ID NO: 130937 - DNA, 397 bp, Homo sapiens; identical to SEQ ID NO: 100175
  misc_feature 1..397: note = chr9:113800084-113800481
  misc_feature 1..397: note = Hyper
  source 1..397: mol_type = genomic DNA

SEQ ID NO: 130938 - DNA, 30 bp, Homo sapiens; identical to SEQ ID NO: 100176
  misc_feature 1..30: note = chr9:113800768-113800798
  misc_feature 1..30: note = Hyper
  source 1..30: mol_type = genomic DNA

SEQ ID NO: 130939 - DNA, 334 bp, Homo sapiens; identical to SEQ ID NO: 100177
  misc_feature 1..334: note = chr9:113801080-113801414
  misc_feature 1..334: note = Hyper
  source 1..334: mol_type = genomic DNA

SEQ ID NO: 130940 - DNA, 199 bp, Homo sapiens; identical to SEQ ID NO: 100178
  misc_feature 1..199: note = chr9:114287440-114287639
  misc_feature 1..199: note = Hyper
  source 1..199: mol_type = genomic DNA

SEQ ID NO: 130941 - DNA, 138 bp, Homo sapiens; identical to SEQ ID NO: 32651
  misc_feature 1..138: note = chr9:114287962-114288100
  misc_feature 1..138: note = Hyper
  source 1..138: mol_type = genomic DNA

SEQ ID NO: 130942 - DNA, 261 bp, Homo sapiens; identical to SEQ ID NO: 100180
  misc_feature 1..261: note = chr9:114361183-114361444
  misc_feature 1..261: note = Hyper
  source 1..261: mol_type = genomic DNA

SEQ ID NO: 130943 - DNA, 30 bp, Homo sapiens; identical to SEQ ID NO: 32652
  misc_feature 1..30: note = chr9:114361785-114361815
  misc_feature 1..30: note = Hyper
  source 1..30: mol_type = genomic DNA

SEQ ID NO: 130944 - DNA, 41 bp, Homo sapiens; identical to SEQ ID NO: 100182
  misc_feature 1..41: note = chr9:114362053-114362094
  misc_feature 1..41: note = Hyper
  source 1..41: mol_type = genomic DNA

SEQ ID NO: 130945 - DNA, 87 bp, Homo sapiens; identical to SEQ ID NO: 100183
  misc_feature 1..87: note = chr9:114631024-114631111
  misc_feature 1..87: note = Hypo
  source 1..87: mol_type = genomic DNA

SEQ ID NO: 130946 - DNA, 26 bp, Homo sapiens
  misc_feature 1..26: note = chr9:114631171-114631197
  misc_feature 1..26: note = Hypo
  source 1..26: mol_type = genomic DNA
acaatgaatcgcgggtatttatccca

SEQ ID NO: 130947 - DNA, 88 bp, Homo sapiens; identical to SEQ ID NO: 100185
  misc_feature 1..88: note = chr9:114710299-114710387
  misc_feature 1..88: note = Hypo
  source 1..88: mol_type = genomic DNA

SEQ ID NO: 130948 - DNA, 32 bp, Homo sapiens; identical to SEQ ID NO: 100187
  misc_feature 1..32: note = chr9:114784817-114784849
  misc_feature 1..32: note = Hypo
  source 1..32: mol_type = genomic DNA

SEQ ID NO: 130949 - DNA, 146 bp, Homo sapiens; identical to SEQ ID NO: 100188
  misc_feature 1..146: note = chr9:114931839-114931985
  misc_feature 1..146: note = Hypo
  source 1..146: mol_type = genomic DNA

SEQ ID NO: 130950 - DNA, 19 bp, Homo sapiens
  misc_feature 1..19: note = chr9:115067926-115067945
  misc_feature 1..19: note = Hypo
  source 1..19: mol_type = genomic DNA
ataagagctttcagccggg

SEQ ID NO: 130951 - DNA, 79 bp, Homo sapiens; identical to SEQ ID NO: 100190
  misc_feature 1..79: note = chr9:115068245-115068324
  misc_feature 1..79: note = Hypo
  source 1..79: mol_type = genomic DNA

SEQ ID NO: 130952 - DNA, 30 bp, Homo sapiens; identical to SEQ ID NO: 42183
  misc_feature 1..30: note = chr9:115087309-115087339
  misc_feature 1..30: note = Hypo
  source 1..30: mol_type = genomic DNA

SEQ ID NO: 130953 - DNA, 120 bp, Homo sapiens; identical to SEQ ID NO: 100192
  misc_feature 1..120: note = chr9:115087595-115087715
  misc_feature 1..120: note = Hypo
  source 1..120: mol_type = genomic DNA

SEQ ID NO: 130954 - DNA, 146 bp, Homo sapiens; identical to SEQ ID NO: 42185
  misc_feature 1..146: note = chr9:115172301-115172447
  misc_feature 1..146: note = Hypo
  source 1..146: mol_type = genomic DNA

SEQ ID NO: 130955 - DNA, 30 bp, Homo sapiens; identical to SEQ ID NO: 100194
  misc_feature 1..30: note = chr9:115202051-115202081
  misc_feature 1..30: note = Hypo
  source 1..30: mol_type = genomic DNA

SEQ ID NO: 130956 - DNA, 39 bp, Homo sapiens; identical to SEQ ID NO: 100195
  misc_feature 1..39: note = chr9:115478932-115478971
  misc_feature 1..39: note = Hypo
  source 1..39: mol_type = genomic DNA

SEQ ID NO: 130957 - DNA, 30 bp, Homo sapiens; identical to SEQ ID NO: 42187
  misc_feature 1..30: note = chr9:115599305-115599335
  misc_feature 1..30: note = Hypo
  source 1..30: mol_type = genomic DNA

SEQ ID NO: 130958 - DNA, 635 bp, Homo sapiens; identical to SEQ ID NO: 100197
  misc_feature 1..635: note = chr9:115652922-115653557
  misc_feature 1..635: note = Hyper
  source 1..635: mol_type = genomic DNA

SEQ ID NO: 130959 - DNA, 30 bp, Homo sapiens; identical to SEQ ID NO: 42188
  misc_feature 1..30: note = chr9:115773781-115773811
  misc_feature 1..30: note = Hypo
  source 1..30: mol_type = genomic DNA

SEQ ID NO: 130960 - DNA, 37 bp, Homo sapiens; identical to SEQ ID NO: 100199
  misc_feature 1..37: note = chr9:115774571-115774608
  misc_feature 1..37: note = Hyper
  source 1..37: mol_type = genomic DNA

SEQ ID NO: 130961 - DNA, 53 bp, Homo sapiens; identical to SEQ ID NO: 100200
  misc_feature 1..53: note = chr9:115818864-115818917
  misc_feature 1..53: note = Hyper
  source 1..53: mol_type = genomic DNA

SEQ ID NO: 130962 - DNA, 63 bp, Homo sapiens; identical to SEQ ID NO: 100201
  misc_feature 1..63: note = chr9:115913757-115913820
  misc_feature 1..63: note = Hyper
  source 1..63: mol_type = genomic DNA

SEQ ID NO: 130963 - DNA, 40 bp, Homo sapiens; identical to SEQ ID NO: 100202
  misc_feature 1..40: note = chr9:116028536-116028576
  misc_feature 1..40: note = Hypo
  source 1..40: mol_type = genomic DNA

SEQ ID NO: 130964 - DNA, 30 bp, Homo sapiens; identical to SEQ ID NO: 100203
  misc_feature 1..30: note = chr9:116060098-116060128
  misc_feature 1..30: note = Hypo
  source 1..30: mol_type = genomic DNA

SEQ ID NO: 130965 - DNA, 37 bp, Homo sapiens; identical to SEQ ID NO: 100204
  misc_feature 1..37: note = chr9:116065790-116065827
  misc_feature 1..37: note = Hypo
  source 1..37: mol_type = genomic DNA

SEQ ID NO: 130966 - DNA, 87 bp, Homo sapiens; identical to SEQ ID NO: 100205
  misc_feature 1..87: note = chr9:116128876-116128963
  misc_feature 1..87: note = Hypo
  source 1..87: mol_type = genomic DNA

SEQ ID NO: 130967 - DNA, 30 bp, Homo sapiens; identical to SEQ ID NO: 100206
  misc_feature 1..30: note = chr9:116270970-116271000
  misc_feature 1..30: note = Hypo
  source 1..30: mol_type = genomic DNA

SEQ ID NO: 130968 - DNA, 109 bp, Homo sapiens; identical to SEQ ID NO: 100207
  misc_feature 1..109: note = chr9:116331277-116331386
  misc_feature 1..109: note = Hypo
  source 1..109: mol_type = genomic DNA

SEQ ID NO: 130969 - DNA, 159 bp, Homo sapiens
  misc_feature 1..159: note = chr9:116450308-116450467
  misc_feature 1..159: note = Hyper
  source 1..159: mol_type = genomic DNA
ggtcaggggagggagcgggcgatctcaccctgcagcccgcacactcaggcctacactccccggtttggagcccagataaccccttcccgtcctcccctcacccgcgggaaccctggagagccggtaggggaggttcgcaccctgcgttgcagctgcctt

SEQ ID NO: 130970 - DNA, 137 bp, Homo sapiens; identical to SEQ ID NO: 100209
  misc_feature 1..137: note = chr9:116542589-116542726
  misc_feature 1..137: note = Hypo
  source 1..137: mol_type = genomic DNA

SEQ ID NO: 130971 - DNA, 80 bp, Homo sapiens; identical to SEQ ID NO: 100210
  misc_feature 1..80: note = chr9:116633829-116633909
  misc_feature 1..80: note = Hypo
  source 1..80: mol_type = genomic DNA

SEQ ID NO: 130972 - DNA, 19 bp, Homo sapiens
  misc_feature 1..19: note = chr9:116634089-116634108
  misc_feature 1..19: note = Hypo
  source 1..19: mol_type = genomic DNA
tcaccgtgttagccaggat

SEQ ID NO: 130973 - DNA, 186 bp, Homo sapiens; identical to SEQ ID NO: 100212
  misc_feature 1..186: note = chr9:116756509-116756695
  misc_feature 1..186: note = Hyper
  source 1..186: mol_type = genomic DNA

SEQ ID NO: 130974 - DNA, 41 bp, Homo sapiens; identical to SEQ ID NO: 100213
  misc_feature 1..41: note = chr9:116800689-116800730
  misc_feature 1..41: note = Hypo
  source 1..41: mol_type = genomic DNA

SEQ ID NO: 130975 - DNA, 221 bp, Homo sapiens; identical to SEQ ID NO: 100214
  misc_feature 1..221: note = chr9:116916349-116916570
  misc_feature 1..221: note = Hyper
  source 1..221: mol_type = genomic DNA

SEQ ID NO: 130976 - DNA, 86 bp, Homo sapiens; identical to SEQ ID NO: 100215
  misc_feature 1..86: note = chr9:116916917-116917003
  misc_feature 1..86: note = Hyper
  source 1..86: mol_type = genomic DNA

SEQ ID NO: 130977 - DNA, 30 bp, Homo sapiens; identical to SEQ ID NO: 100216
  misc_feature 1..30: note = chr9:116917360-116917390
  misc_feature 1..30: note = Hyper
  source 1..30: mol_type = genomic DNA

SEQ ID NO: 130978 - DNA, 126 bp, Homo sapiens; identical to SEQ ID NO: 100217
  misc_feature 1..126: note = chr9:116918762-116918888
  misc_feature 1..126: note = Hyper
  source 1..126: mol_type = genomic DNA

SEQ ID NO: 130979 - DNA, 49 bp, Homo sapiens; identical to SEQ ID NO: 100218
  misc_feature 1..49: note = chr9:117050981-117051030
  misc_feature 1..49: note = Hypo
  source 1..49: mol_type = genomic DNA

SEQ ID NO: 130980 - DNA, 141 bp, Homo sapiens; identical to SEQ ID NO: 100219
  misc_feature 1..141: note = chr9:117267155-117267296
  misc_feature 1..141: note = Hyper
  source 1..141: mol_type = genomic DNA

SEQ ID NO: 130981 - DNA, 82 bp, Homo sapiens; identical to SEQ ID NO: 100222
  misc_feature 1..82: note = chr9:117880343-117880425
  misc_feature 1..82: note = Hyper
  source 1..82: mol_type = genomic DNA

SEQ ID NO: 130982 - DNA, 753 bp, Homo sapiens; identical to SEQ ID NO: 100223
  misc_feature 1..753: note = chr9:118916326-118917079
  misc_feature 1..753: note = Hyper
  source 1..753: mol_type = genomic DNA

SEQ ID NO: 130983 - DNA, 472 bp, Homo sapiens; identical to SEQ ID NO: 100224
  misc_feature 1..472: note = chr9:118917306-118917778
  misc_feature 1..472: note = Hyper
  source 1..472: mol_type = genomic DNA

SEQ ID NO: 130984 - DNA, 198 bp, Homo sapiens; identical to SEQ ID NO: 100225
  misc_feature 1..198: note = chr9:118919150-118919348
  misc_feature 1..198: note = Hyper
  source 1..198: mol_type = genomic DNA

SEQ ID NO: 130985 - DNA, 30 bp, Homo sapiens; identical to SEQ ID NO: 100226
  misc_feature 1..30: note = chr9:118950279-118950309
  misc_feature 1..30: note = Hypo
  source 1..30: mol_type = genomic DNA

SEQ ID NO: 130986 - DNA, 1085 bp, Homo sapiens; identical to SEQ ID NO: 100227
  misc_feature 1..1085: note = chr9:120175273-120176358
  misc_feature 1..1085: note = Hyper
  source 1..1085: mol_type = genomic DNA

SEQ ID NO: 130987 - DNA, 863 bp, Homo sapiens; identical to SEQ ID NO: 100228
  misc_feature 1..863: note = chr9:120176694-120177557
  misc_feature 1..863: note = Hyper
  source 1..863: mol_type = genomic DNA

SEQ ID NO: 130988 - DNA, 140 bp, Homo sapiens; identical to SEQ ID NO: 32665
  misc_feature 1..140: note = chr9:120177898-120178038
  misc_feature 1..140: note = Hyper
  source 1..140: mol_type = genomic DNA

SEQ ID NO: 130989 - DNA, 34 bp, Homo sapiens; identical to SEQ ID NO: 100230
  misc_feature 1..34: note = chr9:120315798-120315832
  misc_feature 1..34: note = Hypo
  source 1..34: mol_type = genomic DNA

SEQ ID NO: 130990 - DNA, 155 bp, Homo sapiens
  misc_feature 1..155: note = chr9:120507292-120507447
  misc_feature 1..155: note = Hyper
  source 1..155: mol_type = genomic DNA
gagcgcccgcgccttcgcgggctgcgcggggctcagggagccgcggccacggctcccgcgcgctcgctcgcccgcaggatctgggcagccccgcggggacccggctctgcgcgcagcccattgtacagctggcgcagccgcgcaaatgacatctg

SEQ ID NO: 130991 - DNA, 37 bp, Homo sapiens; identical to SEQ ID NO: 100232
  misc_feature 1..37: note = chr9:121930100-121930137
  misc_feature 1..37: note = Hypo
  source 1..37: mol_type = genomic DNA

SEQ ID NO: 130992 - DNA, 30 bp, Homo sapiens; identical to SEQ ID NO: 100233
  misc_feature 1..30: note = chr9:122130678-122130708
  misc_feature 1..30: note = Hyper
  source 1..30: mol_type = genomic DNA

SEQ ID NO: 130993 - DNA, 1254 bp, Homo sapiens
  misc_feature 1..1254: note = chr9:122130973-122132227
  misc_feature 1..1254: note = Hyper
  source 1..1254: mol_type = genomic DNA
cctcccttacacacacggacacacacacacaccacgaacacacgcatcaaacgcaaacgacgccgcacacgcaaacacactagcaccacatcaagttcccaccatggtgcacacgtcgggagcgcgcggggacacacacgccactcactcaaacccgcaattagccctttgagccccaggcacaggaaccccctccctagaactggagaagacttggaggcggcggggcggccaggtgaagagcggacaagggtgccggtagggggaggggcagaggagcgcggggacgccccgaatgcggcccggggccgggtccaagggcagcggggctgcggggcgctgcacccggcgccgccttacctggagtcaatgtccgtctttggcggagagctgcgggaggacgctttttattcggctcggtgggaacttgggagagccctgcgtgcagctcgcattccgggcacggcgcggggactgcaggcgtgggggtacctggctcctagcagcctggctcatactcagccgtaaagtccccttcgctggtcccgaggacaggcatgaatcccggctccggaaggcggtcactactccctctgcctcccggctctctcgctctcgctctcgctgttgctcgctcgctctctccctctctcgcgggttcgctcgcctgcgctctcctcctccccgcgcgccagatcagtttgcagccgtggggtccgggagcgaggcggctggcgaatggagagggaagtccaagtgcgccgcggtctccgggcggggagcggcggaggccgggctacgccgggggagggacttagccggcgacggccgaaaatgaatgggggagcggcggccggggggcggggagggaggagctgaacgccggggttgcttccgaggagtgttttgtacatctttaggcggaggaggaggagaagcgagaggaggagagacgggaggccgcctcgagggaagggcggcccgggtgggctggggctgagccgtagggagtttcgtgggtctggggcgtgtagggtgttgtgtctatgcgcacgagcatccaaagggaccgcgcatacgcgcaaacccggaatcctggtgcccttaagcgtgactgtactgtgtgtgtcgcgagtacctgagtgtttctggggcggcaggtgtttccacggccgcgtggatccatcgagtgtgggttttgtctcgggagttgcccgtgtgggtccgtttgtgtctgcgcgtctctctgtgagt

SEQ ID NO: 130994 - DNA, 232 bp, Homo sapiens; identical to SEQ ID NO: 100237
  misc_feature 1..232: note = chr9:123150500-123150732
  misc_feature 1..232: note = Hypo
  source 1..232: mol_type = genomic DNA

SEQ ID NO: 130995 - DNA, 30 bp, Homo sapiens; identical to SEQ ID NO: 42195
  misc_feature 1..30: note = chr9:123272513-123272543
  misc_feature 1..30: note = Hypo
  source 1..30: mol_type = genomic DNA

SEQ ID NO: 130996 - DNA, 79 bp, Homo sapiens; identical to SEQ ID NO: 100239
  misc_feature 1..79: note = chr9:123287834-123287913
  misc_feature 1..79: note = Hypo
  source 1..79: mol_type = genomic DNA

SEQ ID NO: 130997 - DNA, 30 bp, Homo sapiens; identical to SEQ ID NO: 42197
  misc_feature 1..30: note = chr9:123294978-123295008
  misc_feature 1..30: note = Hypo
  source 1..30: mol_type = genomic DNA

SEQ ID NO: 130998 - DNA, 53 bp, Homo sapiens; identical to SEQ ID NO: 100241
  misc_feature 1..53: note = chr9:123295496-123295549
  misc_feature 1..53: note = Hypo
  source 1..53: mol_type = genomic DNA

SEQ ID NO: 130999 - DNA, 30 bp, Homo sapiens; identical to SEQ ID NO: 100242
  misc_feature 1..30: note = chr9:123642193-123642223
  misc_feature 1..30: note = Hypo
  source 1..30: mol_type = genomic DNA

SEQ ID NO: 131000 - DNA, 35 bp, Homo sapiens; identical to SEQ ID NO: 100243
  misc_feature 1..35: note = chr9:123690879-123690914
  misc_feature 1..35: note = Hyper
  source 1..35: mol_type = genomic DNA

SEQ ID NO: 131001 - DNA, 40 bp, Homo sapiens; identical to SEQ ID NO: 100244
  misc_feature 1..40: note = chr9:124061944-124061984
  misc_feature 1..40: note = Hyper
  source 1..40: mol_type = genomic DNA

SEQ ID NO: 131002 - DNA, 71 bp, Homo sapiens; identical to SEQ ID NO: 100245
  misc_feature 1..71: note = chr9:124261319-124261390
  misc_feature 1..71: note = Hyper
  source 1..71: mol_type = genomic DNA

SEQ ID NO: 131003 - DNA, 137 bp, Homo sapiens; identical to SEQ ID NO: 100246
  misc_feature 1..137: note = chr9:124262375-124262512
  misc_feature 1..137: note = Hyper
  source 1..137: mol_type = genomic DNA

SEQ ID NO: 131004 - DNA, 541 bp, Homo sapiens; identical to SEQ ID NO: 100247
  misc_feature 1..541: note = chr9:124361389-124361930
  misc_feature 1..541: note = Hyper
  source 1..541: mol_type = genomic DNA

SEQ ID NO: 131005 - DNA, 141 bp, Homo sapiens; identical to SEQ ID NO: 100248
  misc_feature 1..141: note = chr9:124362183-124362324
  misc_feature 1..141: note = Hyper
  source 1..141: mol_type = genomic DNA

SEQ ID NO: 131006 - DNA, 159 bp, Homo sapiens; identical to SEQ ID NO: 100249
  misc_feature 1..159: note = chr9:124461151-124461310
  misc_feature 1..159: note = Hyper
  source 1..159: mol_type = genomic DNA

SEQ ID NO: 131007 - DNA, 30 bp, Homo sapiens; identical to SEQ ID NO: 100250
  misc_feature 1..30: note = chr9:124499696-124499726
  misc_feature 1..30: note = Hypo
  source 1..30: mol_type = genomic DNA

SEQ ID NO: 131008 - DNA, 30 bp, Homo sapiens; identical to SEQ ID NO: 100251
  misc_feature 1..30: note = chr9:124500396-124500426
  misc_feature 1..30: note = Hypo
  source 1..30: mol_type = genomic DNA

SEQ ID NO: 131009 - DNA, 30 bp, Homo sapiens; identical to SEQ ID NO: 100252
  misc_feature 1..30: note = chr9:124580756-124580786
  misc_feature 1..30: note = Hypo
  source 1..30: mol_type = genomic DNA

SEQ ID NO: 131010 - DNA, 125 bp, Homo sapiens; identical to SEQ ID NO: 100253
  misc_feature 1..125: note = chr9:124751390-124751515
  misc_feature 1..125: note = Hypo
  source 1..125: mol_type = genomic DNA

SEQ ID NO: 131011 - DNA, 51 bp, Homo sapiens
  misc_feature 1..51: note = chr9:124981737-124981788
  misc_feature 1..51: note = Hyper
  source 1..51: mol_type = genomic DNA
cagcctactccccctcgaagagccgaccccgggttccgccacccggctggt

SEQ ID NO: 131012 - DNA, 492 bp, Homo sapiens
  misc_feature 1..492: note = chr9:124990520-124991012
  misc_feature 1..492: note = Hyper
  source 1..492: mol_type = genomic DNA
aagagaaaagagaggcgctcaaggggaggaaaaagcaccctccagcccctcggcgcgccgggtaccggccccgcgtcgggattctcagcgctgcgccggcacaacccccggcgcatcggcgctatcagcgcctattcagacggacaataccggcctcgcctcctcttgattcgcctgtgtctttactaaatcgctttttgagaaattcctccaacatttgcataatgtgttcccgctttccgcgaccccccccccccgctcgcgcgcgcgctcccacactcacaagcacacactcacaggcgcaccctcgtacccctccttcctgcaaccgcccgccaccctgctcggcccggctgggtcccggaccctgcccgaccccggcccgggccgctcacccagtcgttcgccggctcacctggtcggtggcggggccgccctcggccggcagccggcagccctcgggcaacgccggggcggcgttctcatgcttcc

SEQ ID NO: 131013 - DNA, 67 bp, Homo sapiens; identical to SEQ ID NO: 100256
  misc_feature 1..67: note = chr9:125551770-125551837
  misc_feature 1..67: note = Hypo
  source 1..67: mol_type = genomic DNA

SEQ ID NO: 131014 - DNA, 39 bp, Homo sapiens; identical to SEQ ID NO: 42200
  misc_feature 1..39: note = chr9:125623471-125623510
  misc_feature 1..39: note = Hypo
  source 1..39: mol_type = genomic DNA

SEQ ID NO: 131015 - DNA, 29 bp, Homo sapiens
  misc_feature 1..29: note = chr9:125676678-125676707
  misc_feature 1..29: note = Hypo
  source 1..29: mol_type = genomic DNA
gctgggattacaggcgtgagccaccgagc

SEQ ID NO: 131016 - DNA, 30 bp, Homo sapiens; identical to SEQ ID NO: 100259
  misc_feature 1..30: note = chr9:126090073-126090103
  misc_feature 1..30: note = Hypo
  source 1..30: mol_type = genomic DNA

SEQ ID NO: 131017 - DNA, 30 bp, Homo sapiens; identical to SEQ ID NO: 100260
  misc_feature 1..30: note = chr9:126090387-126090417
  misc_feature 1..30: note = Hypo
  source 1..30: mol_type = genomic DNA

SEQ ID NO: 131018 - DNA, 67 bp, Homo sapiens; identical to SEQ ID NO: 100261
  misc_feature 1..67: note = chr9:126110108-126110175
  misc_feature 1..67: note = Hypo
  source 1..67: mol_type = genomic DNA

SEQ ID NO: 131019 - DNA, 30 bp, Homo sapiens; identical to SEQ ID NO: 100262
  misc_feature 1..30: note = chr9:126111852-126111882
  misc_feature 1..30: note = Hypo
  source 1..30: mol_type = genomic DNA

SEQ ID NO: 131020 - DNA, 54 bp, Homo sapiens; identical to SEQ ID NO: 100263
  misc_feature 1..54: note = chr9:126125543-126125597
  misc_feature 1..54: note = Hypo
  source 1..54: mol_type = genomic DNA

SEQ ID NO: 131021 - DNA, 331 bp, Homo sapiens; identical to SEQ ID NO: 100264
  misc_feature 1..331: note = chr9:126132902-126133233
  misc_feature 1..331: note = Hypo
  source 1..331: mol_type = genomic DNA

SEQ ID NO: 131022 - DNA, 303 bp, Homo sapiens; identical to SEQ ID NO: 100265
  misc_feature 1..303: note = chr9:126133637-126133940
  misc_feature 1..303: note = Hypo
  source 1..303: mol_type = genomic DNA

SEQ ID NO: 131023 - DNA, 50 bp, Homo sapiens
  misc_feature 1..50: note = chr9:126136156-126136206
  misc_feature 1..50: note = Hyper
  source 1..50: mol_type = genomic DNA
tcgagtgccgctgcccgcctggcttcgggggcccgcgctgcaggtgggat

SEQ ID NO: 131024 - DNA, 305 bp, Homo sapiens; identical to SEQ ID NO: 100266
  misc_feature 1..305: note = chr9:126138009-126138314
  misc_feature 1..305: note = Hyper
  source 1..305: mol_type = genomic DNA

SEQ ID NO: 131025 - DNA, 36 bp, Homo sapiens; identical to SEQ ID NO: 100267
  misc_feature 1..36: note = chr9:126139212-126139248
  misc_feature 1..36: note = Hypo
  source 1..36: mol_type = genomic DNA

SEQ ID NO: 131026 - DNA, 176 bp, Homo sapiens; identical to SEQ ID NO: 100268
  misc_feature 1..176: note = chr9:126140319-126140495
  misc_feature 1..176: note = Hypo
  source 1..176: mol_type = genomic DNA

SEQ ID NO: 131027 - DNA, 36 bp, Homo sapiens; identical to SEQ ID NO: 42206
  misc_feature 1..36: note = chr9:126141357-126141393
  misc_feature 1..36: note = Hypo
  source 1..36: mol_type = genomic DNA

SEQ ID NO: 131028 - DNA, 69 bp, Homo sapiens; identical to SEQ ID NO: 100270
  misc_feature 1..69: note = chr9:126145324-126145393
  misc_feature 1..69: note = Hypo
  source 1..69: mol_type = genomic DNA

SEQ ID NO: 131029 - DNA, 148 bp, Homo sapiens; identical to SEQ ID NO: 100271
  misc_feature 1..148: note = chr9:126152955-126153103
  misc_feature 1..148: note = Hypo
  source 1..148: mol_type = genomic DNA

SEQ ID NO: 131030 - DNA, 340 bp, Homo sapiens; identical to SEQ ID NO: 100272
  misc_feature 1..340: note = chr9:126154211-126154551
  misc_feature 1..340: note = Hypo
  source 1..340: mol_type = genomic DNA

SEQ ID NO: 131031 - DNA, 105 bp, Homo sapiens; identical to SEQ ID NO: 100273
  misc_feature 1..105: note = chr9:126158010-126158115
  misc_feature 1..105: note = Hypo
  source 1..105: mol_type = genomic DNA

SEQ ID NO: 131032 - DNA, 119 bp, Homo sapiens; identical to SEQ ID NO: 100274
  misc_feature 1..119: note = chr9:126169372-126169491
  misc_feature 1..119: note = Hypo
  source 1..119: mol_type = genomic DNA

SEQ ID NO: 131033 - DNA, 30 bp, Homo sapiens; identical to SEQ ID NO: 100275
  misc_feature 1..30: note = chr9:126283294-126283324
  misc_feature 1..30: note = Hypo
  source 1..30: mol_type = genomic DNA

SEQ ID NO: 131034 - DNA, 30 bp, Homo sapiens; identical to SEQ ID NO: 100276
  misc_feature 1..30: note = chr9:126314151-126314181
  misc_feature 1..30: note = Hypo
  source 1..30: mol_type = genomic DNA

SEQ ID NO: 131035 - DNA, 30 bp, Homo sapiens; identical to SEQ ID NO: 100277
  misc_feature 1..30: note = chr9:126349144-126349174
  misc_feature 1..30: note = Hypo
  source 1..30: mol_type = genomic DNA

SEQ ID NO: 131036 - DNA, 30 bp, Homo sapiens; identical to SEQ ID NO: 100278
  misc_feature 1..30: note = chr9:126357733-126357763
  misc_feature 1..30: note = Hypo
  source 1..30: mol_type = genomic DNA

SEQ ID NO: 131037 - DNA, 52 bp, Homo sapiens; identical to SEQ ID NO: 100279
  misc_feature 1..52: note = chr9:126405898-126405950
  misc_feature 1..52: note = Hypo
  source 1..52: mol_type = genomic DNA

SEQ ID NO: 131038 - DNA, 141 bp, Homo sapiens; identical to SEQ ID NO: 100280
  misc_feature 1..141: note = chr9:126569628-126569769
  misc_feature 1..141: note = Hypo
  source 1..141: mol_type = genomic DNA

SEQ ID NO: 131039 - DNA, 30 bp, Homo sapiens; identical to SEQ ID NO: 100281
  misc_feature 1..30: note = chr9:126729042-126729072
  misc_feature 1..30: note = Hypo
  source 1..30: mol_type = genomic DNA

SEQ ID NO: 131040 - DNA, 30 bp, Homo sapiens; identical to SEQ ID NO: 100282
  misc_feature 1..30: note = chr9:126759039-126759069
  misc_feature 1..30: note = Hyper
  source 1..30: mol_type = genomic DNA

SEQ ID NO: 131041 - DNA, 206 bp, Homo sapiens; identical to SEQ ID NO: 100283
  misc_feature 1..206: note = chr9:126760259-126760465
  misc_feature 1..206: note = Hyper
  source 1..206: mol_type = genomic DNA

SEQ ID NO: 131042 - DNA, 165 bp, Homo sapiens; identical to SEQ ID NO: 100284
  misc_feature 1..165: note = chr9:126761476-126761641
  misc_feature 1..165: note = Hyper
  source 1..165: mol_type = genomic DNA

SEQ ID NO: 131043 - DNA, 76 bp, Homo sapiens; identical to SEQ ID NO: 100285
  misc_feature 1..76: note = chr9:126762530-126762606
  misc_feature 1..76: note = Hyper
  source 1..76: mol_type = genomic DNA

SEQ ID NO: 131044 - DNA, 1618 bp, Homo sapiens; identical to SEQ ID NO: 100286
  misc_feature 1..1618: note = chr9:126770190-126771808
  misc_feature 1..1618: note = Hyper
  source 1..1618: mol_type = genomic DNA

SEQ ID NO: 131045 - DNA, 747 bp, Homo sapiens
  misc_feature 1..747: note = chr9:126773231-126773978
  misc_feature 1..747: note = Hyper
  source 1..747: mol_type = genomic DNA
aggctggggagagaccgggaagagcgagaagctacacgctgggctgcagattgggccctagcgggcttggagcgtggatatgctggctggcccccctccccgggagtcacagctctcgccggtctcgccactcaggctctgccgggtacccaggaggcttgcacggccgcctgcagcccgctgtgcagagcccgggccgaaggcggagctcgatgggaaacggccggccgaaggctcttgcaactctgccacaggcctgccttcccgggcctcccaggcgggtgcctgaggccgcggctccaggccgaggggagaccgcagtgagacgagcatccccttgctgcgccttcttaggatagagggtttaattttcctttctgaagatatcgcaggaagctgttcgtatcttaaaaactccaaaccccgcgctctccctcctccctgcctcccccccacccccgccctccagcctcgcccaccagctcccaccatctcgactctcctctgctcctcttgcctctcccctccctcttgggtctcccgccttcccggagcacgcgctgccagggcctggggcgccgagcggccaatggcacggcggcaggacgtgatgtcaggcgcggctgtagaaaaggcgcggaggcttgcgctggcgcggactgcagagccggggctgggctaggcgcgcgcttggagagcattgcgcgcggctgggcccgcggccggcggctcctcctcccactctgc

SEQ ID NO: 131046 - DNA, 1106 bp, Homo sapiens
  misc_feature 1..1106: note = chr9:126774038-126775144
  misc_feature 1..1106: note = Hyper
  source 1..1106: mol_type = genomic DNA
tcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcccgccgcgatgctgttccacagtctgtcgggccccgaggtgcacggggtcatcgacgagatggaccgcagggccaagagcgaggctcccgccatcagctccgccatcgaccgcggcgacaccgagacggtaggcgcgcggctgtggggtcggggctgagagctgggatggggccgggccagtcagcgcctctgctccccgaagtttggggagcgtccttcgtgccgcacgggactgggtgctggggatcctcggtcagaatgcaaggccggtggctcccggttcgggggaaacccggctgctgggacgcagaagggaaacaaggttgaaaccgaaatctcggccctgggggtagaggagagcgtttcttccgaactggaagcgaagtcccatccgcggcccggggcggctcccttctcaccttgcccggtgccggggtcgacagccccgcgctctcctccacctctcggctccggttgctggcggcgccgcgagcggcgccagggaagggcgaaccagctgggag

SEQ ID NO: 131047 - DNA, 116 bp, Homo sapiens; identical to SEQ ID NO: 100291
  misc_feature 1..116: note = chr9:126775412-126775528
  misc_feature 1..116: note = Hyper
  source 1..116: mol_type = genomic DNA

SEQ ID NO: 131048 - DNA, 292 bp, Homo sapiens
  misc_feature 1..292: note = chr9:126776044-126776336
  misc_feature 1..292: note = Hyper
  source 1..292: mol_type = genomic DNA
gcctgggttctgaaccgcccagaaatggaaatgggccttttggggtggggggaagcgcgccgcatgtcctggcagccccctccgcgttcagggtagccaaggccacagagggagttgtgggtgccggtttcccggcggcggaggggccgctggctgacgcaggcgctgctgtcttccgcctccctcccttcgcagaccatgccgtccatcagcagtgaccgcgccgcgctgtgcgccggctgcgggggcaagatctcggaccgctactacctgctggcggtggacaagcagt

SEQ ID NO: 131049 - DNA, 402 bp, Homo sapiens
  misc_feature 1..402: note = chr9:126777586-126777988
  misc_feature 1..402: note = Hyper
  source 1..402: mol_type = genomic DNA
ggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctggtgagtgcgcggcgcacgaagcgcccccatagggttgggggaaagtgtgcggcctcgacggccgggagctggattgaatctctgtgtgctgggcaaatagcgagccttaagcaccggacggcctcgcagaagggacattagccccctgggcttccagactgtgcgtcctcggctggagcgggag

SEQ ID NO: 131050 - DNA, 137 bp, Homo sapiens; identical to SEQ ID NO: 100296
  misc_feature 1..137: note = chr9:126778381-126778518
  misc_feature 1..137: note = Hyper
  source 1..137: mol_type = genomic DNA

SEQ ID NO: 131051 - DNA, 103 bp, Homo sapiens
  misc_feature 1..103: note = chr9:126779147-126779250
  misc_feature 1..103: note = Hyper
  source 1..103: mol_type = genomic DNA
aaaccgagttcagaccggctcccccaacaccaagccgcttctatttatcaagtgggtcaacttccactcggaagcacctcgcggggctcggctccagggcacc

SEQ ID NO: 131052 - DNA, 839 bp, Homo sapiens
  misc_feature 1..839: note = chr9:126779476-126780315
  misc_feature 1..839: note = Hyper
  source 1..839: mol_type = genomic DNA
tctttttttcctttccgttctctccgtcctttctctctatctctgtctctgtgtgtgtcgtgtttgttcccgtgccctcctctccgaccttggccggggctcctagtcctgagagaaacggcgttcggtgcgccggcggtggctatgcggctggctctttcggggctcccgggactaggttggggaaagagggcatctccccggcctctcggggcccagcccagtcttcctagatctggcgtccgcccttccctcccctcccgcactggcaggagagaaatggccgcagtgtgggccgcggggcagctaggactggaaagcggggaccctggagggtgcgatcgcggacggggtgtgcgggcgcgggtcgtgtgcgtgtgcgtgcagggttccgaccacggggacacgagcttgtttgtggcagtgtcccacatcctgtggcccagccacgacgaccccttgcaaagcctcttgctctggggacagtccctccgaggcgcggcggcaccttactgaagggcggcgagctgggggccgagtggggagggggcgccgtcggggcgccgggcgctgggcttacagcagagccgcgggccgcggggtcggaaagtccttccggggcggggccgcagcggcctcttcccgcagcccctcgggcccgggccccggtggaacggaaacctccccctaccccgggaggggctgccagcgggctgggggtgcgaaaacggcggcaggagcgggcgaggggcccgggccgcgcactttgcgcctgggtttgcgcgccgcggccgcgggagtcccgcgcggaccggccggacgcccggcctcccccagcc

SEQ ID NO: 131053 - DNA, 390 bp, Homo sapiens; identical to SEQ ID NO: 100300
  misc_feature 1..390: note = chr9:126780564-126780954
  misc_feature 1..390: note = Hyper
  source 1..390: mol_type = genomic DNA

SEQ ID NO: 131054 - DNA, 213 bp, Homo sapiens; identical to SEQ ID NO: 100301
  misc_feature 1..213: note = chr9:126781161-126781374
  misc_feature 1..213: note = Hyper
  source 1..213: mol_type = genomic DNA

SEQ ID NO: 131055 - DNA, 30 bp, Homo sapiens; identical to SEQ ID NO: 32689
  misc_feature 1..30: note = chr9:126782415-126782445
  misc_feature 1..30: note = Hyper
  source 1..30: mol_type = genomic DNA

SEQ ID NO: 131056 - DNA, 140 bp, Homo sapiens; identical to SEQ ID NO: 100303
  misc_feature 1..140: note = chr9:126783400-126783540
  misc_feature 1..140: note = Hyper
  source 1..140: mol_type = genomic DNA

SEQ ID NO: 131057 - DNA, 294 bp, Homo sapiens; identical to SEQ ID NO: 32691
  misc_feature 1..294: note = chr9:126785057-126785351
  misc_feature 1..294: note = Hyper
  source 1..294: mol_type = genomic DNA

SEQ ID NO: 131058 - DNA, 30 bp, Homo sapiens; identical to SEQ ID NO: 100305
  misc_feature 1..30: note = chr9:126794671-126794701
  misc_feature 1..30: note = Hyper
  source 1..30: mol_type = genomic DNA

SEQ ID NO: 131059 - DNA, 66 bp, Homo sapiens; identical to SEQ ID NO: 100306
  misc_feature 1..66: note = chr9:126807864-126807930
  misc_feature 1..66: note = Hyper
  source 1..66: mol_type = genomic DNA

SEQ ID NO: 131060 - DNA, 75 bp, Homo sapiens; identical to SEQ ID NO: 100307
  misc_feature 1..75: note = chr9:126872665-126872740
  misc_feature 1..75: note = Hyper
  source 1..75: mol_type = genomic DNA

SEQ ID NO: 131061 - DNA, 170 bp, Homo sapiens; identical to SEQ ID NO: 100308
  misc_feature 1..170: note = chr9:126930838-126931008
  misc_feature 1..170: note = Hypo
  source 1..170: mol_type = genomic DNA

SEQ ID NO: 131062 - DNA, 54 bp, Homo sapiens; identical to SEQ ID NO: 100309
  misc_feature 1..54: note = chr9:127106240-127106294
  misc_feature 1..54: note = Hypo
  source 1..54: mol_type = genomic DNA

SEQ ID NO: 131063 - DNA, 410 bp, Homo sapiens; identical to SEQ ID NO: 100310
  misc_feature 1..410: note = chr9:127212654-127213064
  misc_feature 1..410: note = Hyper
  source 1..410: mol_type = genomic DNA

SEQ ID NO: 131064 - DNA, 171 bp, Homo sapiens; identical to SEQ ID NO: 100311
  misc_feature 1..171: note = chr9:127215802-127215973
  misc_feature 1..171: note = Hyper
  source 1..171: mol_type = genomic DNA

SEQ ID NO: 131065 - DNA, 196 bp, Homo sapiens; identical to SEQ ID NO: 100312
  misc_feature 1..196: note = chr9:127239774-127239970
  misc_feature 1..196: note = Hyper
  source 1..196: mol_type = genomic DNA

SEQ ID NO: 131066 - DNA, 681 bp, Homo sapiens
  misc_feature 1..681: note = chr9:127265595-127266276
  misc_feature 1..681: note = Hyper
  source 1..681: mol_type = genomic DNA
gtccgtagtggtagccggacaccttgtccccgcacacggggcacagctcgtccaggtcctcgtcgtacgaatagtccatgcccgcggcgtccgcctgcggagggacagcgggtcagggagggccggcggagaccggcagcctggggtccccgcggccgccgccccagccgctgtcgccggcccgtcgcgtaatcccctctctgtgcccaggcgctgccgccggcacccaccgagcgccccgcgcagcgtcccggggtgggtccggtgcagtccccgcgcccggccttcccctgccaggccccacgctcccgccccgtccggggggctcctcccgcgcggaccccgtcgcgcccgatctggggccctcgggttcgatgcgcttcgattgggattcgtttgtctgagaacaaaaccccgattctgagaaaaagagatgggctcagccgcggggaagacgccaggggacccaggagcgctggggcgcccggcccgggtgttctgggaacccgacagagacgaaggaggcagagacagagtccgggggagccagagatgggaagaaactctggcgagagacaacgaccgacgccaccgggcgcagacacgaggccagtccgagagtgccagagacacagacactgagacgcccagctagagagaacccggcggggacgagacaca

SEQ ID NO: 131067 - DNA, 1160 bp, Homo sapiens
  misc_feature 1..1160: note = chr9:127266336-127267496
  misc_feature 1..1160: note = Hyper
  source 1..1160: mol_type = genomic DNA
agagagagagagagagaaacgaggggtgggggattggatcagagactcggagagacagcggaggcccgaagagaaaacccaagagagactgacgcagagccagagacacaacgatagacgacagacagagacgccgagacgagaggagccccggagagacgaggccggggagctacagaaacacggagagaaaacctggaggcggaagcgcccagcccgagggtcggggacaggggacgcgcggaaacctgccgggcaggagcccaagcgccaaggcgaggccccgcagggtcggacccagacgggggcccgggccgcaggaggcggaaaacgacggcgccgggaccgagagcccgaaaacgcagagccgccgggaccccctccccgggggagacaaagccgcagcagcgacggcaacgggaggcgcagcccgagccgccgctgccaccgggacgtcgggcggggagacctcgggcgggggtcggcgggctccgggaagccgagcccgaggcgagggagcgacctcgggcggagaggcgaagtccggaggagggaagcgcgaagagccagggcccgggacgcgagagggggcgcgacggcggctgcggtcggcccggcgcccacctggtcgctcctgcgagcagcgccccgcgtcccgcccgcgcggagcccgcacctctcggccgcgccgccgccgccggcgaggagccgcacccgggcgcagcgccgcccgcccgcgatgacggccgctcgggccggggacggggaggcgggggcgcggggctggcggcgcgggggcctcggctcccccctcccgcctccccgccccccatcctgcctccctgttcccccccgcaccgccgccggggccgctccgaggcgcacctgggacccgggcccctcagccgccaccccgccctgcgccaacccgccgcgccggggccgggggccggcccctctatatcggcgcgtgcggtatccgggggcggaggcccggtcgtgtcctccccccaagcccggcccgcgccggcaccctctccgcagtccagctcgagtcttcgccctcatcctccaggccccccagccgcagcccggctccccggaccccgagcgcggccagagagctgcggagcccgagtgccccgcgatctgggcaggta

SEQ ID NO: 131068 - DNA, 127 bp, Homo sapiens; identical to SEQ ID NO: 100318
  misc_feature 1..127: note = chr9:127421402-127421529
  misc_feature 1..127: note = Hyper
  source 1..127: mol_type = genomic DNA

SEQ ID NO: 131069 - DNA, 142 bp, Homo sapiens; identical to SEQ ID NO: 100319
  misc_feature 1..142: note = chr9:127539774-127539916
  misc_feature 1..142: note = Hyper
  source 1..142: mol_type = genomic DNA

SEQ ID NO: 131070 - DNA, 133 bp, Homo sapiens; identical to SEQ ID NO: 100320
  misc_feature 1..133: note = chr9:127597207-127597340
  misc_feature 1..133: note = Hypo
  source 1..133: mol_type = genomic DNA

SEQ ID NO: 131071 - DNA, 82 bp, Homo sapiens; identical to SEQ ID NO: 100323
  misc_feature 1..82: note = chr9:127950686-127950768
  misc_feature 1..82: note = Hypo
  source 1..82: mol_type = genomic DNA

SEQ ID NO: 131072 - DNA, 30 bp, Homo sapiens; identical to SEQ ID NO: 100324
  misc_feature 1..30: note = chr9:128104149-128104179
  misc_feature 1..30: note = Hypo
  source 1..30: mol_type = genomic DNA

SEQ ID NO: 131073 - DNA, 40 bp, Homo sapiens; identical to SEQ ID NO: 100325
  misc_feature 1..40: note = chr9:128118055-128118095
  misc_feature 1..40: note = Hypo
  source 1..40: mol_type = genomic DNA

SEQ ID NO: 131074 - DNA, 46 bp, Homo sapiens; identical to SEQ ID NO: 100326
  misc_feature 1..46: note = chr9:128190094-128190140
  misc_feature 1..46: note = Hypo
  source 1..46: mol_type = genomic DNA

SEQ ID NO: 131075 - DNA, 30 bp, Homo sapiens; identical to SEQ ID NO: 100327
  misc_feature 1..30: note = chr9:128191341-128191371
  misc_feature 1..30: note = Hypo
  source 1..30: mol_type = genomic DNA

SEQ ID NO: 131076 - DNA, 513 bp, Homo sapiens; identical to SEQ ID NO: 100328
  misc_feature 1..513: note = chr9:128651901-128652414
  misc_feature 1..513: note = Hyper
  source 1..513: mol_type = genomic DNA

SEQ ID NO: 131077 - DNA, 30 bp, Homo sapiens; identical to SEQ ID NO: 42214
  misc_feature 1..30: note = chr9:128750886-128750916
  misc_feature 1..30: note = Hypo
  source 1..30: mol_type = genomic DNA

SEQ ID NO: 131078 - DNA, 122 bp, Homo sapiens; identical to SEQ ID NO: 42215
  misc_feature 1..122: note = chr9:128759852-128759974
  misc_feature 1..122: note = Hypo
  source 1..122: mol_type = genomic DNA

SEQ ID NO: 131079 - DNA, 111 bp, Homo sapiens; identical to SEQ ID NO: 100331
  misc_feature 1..111: note = chr9:128777807-128777918
  misc_feature 1..111: note = Hypo
  source 1..111: mol_type = genomic DNA

SEQ ID NO: 131080 - DNA, 176 bp, Homo sapiens; identical to SEQ ID NO: 100332
  misc_feature 1..176: note = chr9:128824558-128824734
  misc_feature 1..176: note = Hypo
  source 1..176: mol_type = genomic DNA

SEQ ID NO: 131081 - DNA, 30 bp, Homo sapiens; identical to SEQ ID NO: 100333
  misc_feature 1..30: note = chr9:128874699-128874729
  misc_feature 1..30: note = Hypo
  source 1..30: mol_type = genomic DNA

SEQ ID NO: 131082 - DNA, 229 bp, Homo sapiens; identical to SEQ ID NO: 100334
  misc_feature 1..229: note = chr9:128984848-128985077
  misc_feature 1..229: note = Hyper
  source 1..229: mol_type = genomic DNA

SEQ ID NO: 131083 - DNA, 30 bp, Homo sapiens; identical to SEQ ID NO: 100335
  misc_feature 1..30: note = chr9:129269531-129269561
  misc_feature 1..30: note = Hypo
  source 1..30: mol_type = genomic DNA

SEQ ID NO: 131084 - DNA, 364 bp, Homo sapiens
  misc_feature 1..364: note = chr9:129276607-129276971
  misc_feature 1..364: note = Hyper
  source 1..364: mol_type = genomic DNA
cgggaccccgccctgcgctccgcccccaaacacgggttctcacgcggtccggccgcgcgggggcgcccggctccccggccctcgctgggccctgcgggaacgccccggccgcgcactggggatgctcggaccccagcacacacgaggcggagctccgcggactggaggcaaatcaatccctcggcaccgcgctacggacgtgtgtttggaaggaggctagcccgccgcgcaagtccccgcagcgccccgccggcctcccaccccctgcggcgtccggacctcgtggacctggggtggctcccatagactgcggggccgggcccagccgcgctcgctttggtcgggaatgcgggtcgactggaga

SEQ ID NO: 131085 - DNA, 579 bp, Homo sapiens
  misc_feature 1..579: note = chr9:129372722-129373301
  misc_feature 1..579: note = Hyper
  source 1..579: mol_type = genomic DNA
ggcagctcatagagccgtgctcgagggaggcgggtagcgcagaggagagggtgcaaggccctaagaagaggagcggggggactagggcggggctcaatggagctggggcgtccgcagactggaaggagccgggacccccgctccagagcctccctttccattctcgcttcttccagtgattccgagcccccgactcagtctttcccccaggtagagagaatccgaggctgtttctgccgctgaaatctgagcgggagagcatcccgaagccgcctgcgtggagcgagcagcccccgcgtcatgggccagaggcgcccgggagaatctgcgggtcacggatcacacccgcaggggcctggcggagcaaggtgccgttcgccgcctgcgggcaggagccggctctgggcctcggcccctgctgtgccgtccagtcggccgcttcttcgcttcttcggcaagggaagcggtggagaggcgcgggagccccgattgtgctggagagatctgggacccctgcgcgtctgcgtgcgaaggacccgagaccggccaactcagctgggagcacgggacacgaggagt

SEQ ID NO: 131086 - DNA, 30 bp, Homo sapiens; identical to SEQ ID NO: 100340
  misc_feature 1..30: note = chr9:129373610-129373640
  misc_feature 1..30: note = Hyper
  source 1..30: mol_type = genomic DNA

SEQ ID NO: 131087 - DNA, 30 bp, Homo sapiens; identical to SEQ ID NO: 100341
  misc_feature 1..30: note = chr9:129374281-129374311
  misc_feature 1..30: note = Hyper
  source 1..30: mol_type = genomic DNA

SEQ ID NO: 131088 - DNA, 165 bp, Homo sapiens; identical to SEQ ID NO: 100342
  misc_feature 1..165: note = chr9:129374814-129374979
  misc_feature 1..165: note = Hyper
  source 1..165: mol_type = genomic DNA

SEQ ID NO: 131089 - DNA, 88 bp, Homo sapiens; identical to SEQ ID NO: 100343
  misc_feature 1..88: note = chr9:129375295-129375383
  misc_feature 1..88: note = Hyper
  source 1..88: mol_type = genomic DNA

SEQ ID NO: 131090 - DNA, 1073 bp, Homo sapiens; identical to SEQ ID NO: 100344
  misc_feature 1..1073: note = chr9:129375725-129376798
  misc_feature 1..1073: note = Hyper
  source 1..1073: mol_type = genomic DNA

SEQ ID NO: 131091 - DNA, 1147 bp, Homo sapiens
  misc_feature 1..1147: note = chr9:129377017-129378164
  misc_feature 1..1147: note = Hyper
  source 1..1147: mol_type = genomic DNA
agagggccgcaagtacgcctccggcaggcgtcctgaggggacaggacagctccagtcgccacccaccatcctttccaggcttaggttctagagctgccactccgatgtggtaggtggcgggtggcaggggtgatggaggacctagcaatcaccttggcgagcttgggagaggcgcaaggtcacctggggtgggggagattctaagagaaaaacgtctccctggtcactcaaaccacagattttggggagatcggggatagaagaccacgaacgccaccgtggggcgtgtcagccagcgagcgccccagcctcacctcgcctgtcttggtcccagccggccaccctgcgccgtgctcgttgtcatttgtcttaacacggagcgcggattctccggagaaggggagagcacagcgccgagccaaggctcgaggcccgcggcctctccacgccggagcccgaggactgggacggactagccggggccgcccggcccctggcgcggcggtccggggagcgcaggcggcaggcggtgatcccgggcggcccgagccctcggggccgagggctgtgggcccggtgcgaccgggacgccggggctgggccgggcggcgctgacggccgggctttcgccctgtgcgctacaggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagtaagcgcttctcgtcctccttccccgccaccgcccggcactcgagcccggtcagccccctgccgggcccggcccgcgcccgctctgccgccggctctgtgcgcggctgggccgggcagctccaagggttccgagagctgcgcgtcttggggctggggcggaccagcccagcccagcgggcactgatggggtcctgggagcctccggacggcccccagttgccatccgttgtcccggaatcctgcgctgggccggccgagggatttggtgcctgggtcctgggatatagggtctggcgctacggaggcctgaattg

SEQ ID NO: 131092 - DNA, 30 bp, Homo sapiens; identical to SEQ ID NO: 32714
  misc_feature 1..30: note = chr9:129380664-129380694
  misc_feature 1..30: note = Hyper
  source 1..30: mol_type = genomic DNA

SEQ ID NO: 131093 - DNA, 107 bp, Homo sapiens
  misc_feature 1..107: note = chr9:129381111-129381218
  misc_feature 1..107: note = Hyper
  source 1..107: mol_type = genomic DNA
aaaatggagtctaatcgcttgtaagacagctcccaggtttggcgacccgagacccgctggggtgcaagcgggcgcctttgtgcacggcgagacgcggggttccggcc

SEQ ID NO: 131094 - DNA, 30 bp, Homo sapiens; identical to SEQ ID NO: 100350
  misc_feature 1..30: note = chr9:129381473-129381503
  misc_feature 1..30: note = Hyper
  source 1..30: mol_type = genomic DNA

SEQ ID NO: 131095 - DNA, 30 bp, Homo sapiens; identical to SEQ ID NO: 100351
  misc_feature 1..30: note = chr9:129384076-129384106
  misc_feature 1..30: note = Hyper
  source 1..30: mol_type = genomic DNA

SEQ ID NO: 131096 - DNA, 910 bp, Homo sapiens
  misc_feature 1..910: note = chr9:129385872-129386782
  misc_feature 1..910: note = Hyper
  source 1..910: mol_type = genomic DNA
tccaactcccaaagccggatgggttctctaagtcctcctataccgaccttccggaaggtgcgggctctacattgttgctaatctcccccagaacgcccagcctgggaggggtggggagggggagtcgctacccgagggctgggagcagggtgtcactgacctcctctgcgcggattgccccctgtagggccagccctggccagcggaagaaaaaggttagaataattgccttcccctgggcgggagagcttccttcgacgtccggacacgcggatggggcggctttcagcggcctccacccgcgcacccctccaggcccacctctcggcggttcgtgcagcatgttctttactgggagtgggatgacaccatgcataggctcctgggctccgcagccgagccgcgggcaccagcggcggttgatgaatttcggtgtcaccaggggtttagcccggatttgggaaccgcgcgctctaatacgcgcacacggtcctgccctttctaaagcgcagccctttcacccagcagctgatttatggaggaattcgatcctgggacgcgctaggctgaagcccggagtccagggccctgcagcagctttcgggcttctcagcgtttcggggacccttggtggctcgggggctctcttgggctggggtcggggtgccccgccaggtggggccttacgcggtccagaaagagccagtgattctccttggagccactgcaggctcccgctggagggagtaagactggcggggagagctggcattttcattccttgttgagcacagccctcgcccctccccaagccctcctgccgaccccctcgggctggccaaaagcagcaagttcgggaggtttgtttattgagagaacagaaaattaggggttgcgggggagaatctaa

SEQ ID NO: 131097 - DNA, 1729 bp, Homo sapiens
  misc_feature 1..1729: note = chr9:129387515-129389244
  misc_feature 1..1729: note = Hyper
  source 1..1729: mol_type = genomic DNA
ttgggcctcaggagccggagcgttgccgtgggggcgggggaaggggtggttttgcgggtgccttaattggcagcgtctggaaaatggggacagtgaccccacgactagaggatgaatggggggagggttagtgggatgtgtttgcctcctctgaccgagagcacgggtcctgctctgtcccctcttcccaggaaaggtggcactccgggtgcacacccaccacccccattaaagcgggattgaccagaagagagaggccgaatggagatgccaggctggggccctcggcggggcagatttcgttggatccctgggactaatgtcgcagcgctcgcactcctgcaggtctccagggttggccattcccggctgcatgctcggcccctttcttccgagggtgaattcctttgttccacccccacggaaaccctcttctccgccaggcccgtggcgcctttctcgccacctccgccgccgccgccgccaccctcgtcccaccgtttgcagggctttcctgcggcgctctggccgcagagacccagccctgtctgccgactggcccttcgacgtcgccgccgtgcctgagccccgctgcctgctcggacaagcagaactccggcaggcgcagcgggcgccgaggcttgggctttagccgtggcgctcgcctcggcgcagtggggagccgcgggcgtcggagaagcggccgcgctgttccgggtcactgcaccggctgaaaaaaccaaaagcaaaaccaacacccagaaacgaagcctgcgtgcccccgggggctccgttttgctcccctcatggacatgggggtggggagctcgtggggtttcagcccaaaggctccagtcagtggaaccggagggggacttcggaggaatttgtctctgatgtcccggctccctggcctcctattagaactcgtagaggatccgctctggagtccccgtgcgccctggcagaggtcggggacgccagagtgcacgcagtctcctgcgcgccgagcccaggctccgggcgcagggaggatcgggctgagagcagggtgtcacctcgtaaaagcgacaggcaaggactgttttatggggagggagaaggagcaggaagtgatgcttccatctctgacagcatagggaccgggagctccgatggaggaaaccctttccgggcaggacgagtagagggacaggacatggccggggaccatgggattcgctgccattaagtatgggacgggcaggcgagagcggggaaggggaccgatggagccagaagccctgagctcacctcccgcccgtcctctcctggagccccctctgcaatcccggctcagtcggcaaccggcccttccttccaggtcaggggtgggggagagactttctccctcgaaacacttgataccaactttgtttttttggcaagaaaaataagccttgtttggaaaggggtgggtggggggcgtcgagcgagcgagggaaggagcaaggaggcggcggcggagcaaactctgcggattaggtttcagcgcctccgccccacccccagccccgcggcggtgatttgtgtgcgggggtctgtgaccctgcaagcatcaaacggcccgcgggaaccggccgagttcagagggacagtgggccgaagggcggcctaagacaacgcagatggttcctatcagcccggccgggcccgcagcgtccgccggtccgtccgggctcctctgcag

SEQ ID NO: 131098 - DNA, 411 bp, Homo sapiens; identical to SEQ ID NO: 100357
  misc_feature 1..411: note = chr9:129400848-129401259
  misc_feature 1..411: note = Hyper
  source 1..411: mol_type = genomic DNA

SEQ ID NO: 131099 - DNA, 109 bp, Homo sapiens; identical to SEQ ID NO: 100358
  misc_feature 1..109: note = chr9:129414414-129414523
  misc_feature 1..109: note = Hyper
  source 1..109: mol_type = genomic DNA

SEQ ID NO: 131100 - DNA, 215 bp, Homo sapiens; identical to SEQ ID NO: 100359
  misc_feature 1..215: note = chr9:129438508-129438723
  misc_feature 1..215: note = Hyper
  source 1..215: mol_type = genomic DNA

SEQ ID NO: 131101 - DNA, 678 bp, Homo sapiens; identical to SEQ ID NO: 100360
  misc_feature 1..678: note = chr9:129445222-129445900
  misc_feature 1..678: note = Hyper
  source 1..678: mol_type = genomic DNA

SEQ ID NO: 131102 - DNA, 346 bp, Homo sapiens
  misc_feature 1..346: note = chr9:129485680-129486026
  misc_feature 1..346: note = Hyper
  source 1..346: mol_type = genomic DNA
agagccgcctgacaccgtgatatccgcctggctcgctgcgctccgggtgatggatggggcggagctccccaccccccagccccggaacctggcgcccctcccagaaacaccgctccgctgccacacacgcggccgccggactcccagccaccggcgcactcacgcggcgccccccacgcatcagcccggcgcgcacgaagggaaccgttcctcttcccagtcccctggcgctagcaccagcaggactgcccttagcgcacaccacaccttacccacttgcccatcacacagcctcttccgcgcacgcacatacacatgcatgcaagctgcacgccacccctcccgc

SEQ ID NO: 131103 - DNA, 38 bp, Homo sapiens; identical to SEQ ID NO: 100363
  misc_feature 1..38: note = chr9:129627928-129627966
  misc_feature 1..38: note = Hypo
  source 1..38: mol_type = genomic DNA

SEQ ID NO: 131104 - DNA, 412 bp, Homo sapiens; identical to SEQ ID NO: 100364
  misc_feature 1..412: note = chr9:130179969-130180381
  misc_feature 1..412: note = Hypo
  source 1..412: mol_type = genomic DNA

SEQ ID NO: 131105 - DNA, 103 bp, Homo sapiens; identical to SEQ ID NO: 100365
  misc_feature 1..103: note = chr9:130248346-130248449
  misc_feature 1..103: note = Hypo
  source 1..103: mol_type = genomic DNA

SEQ ID NO: 131106 - DNA, 30 bp, Homo sapiens; identical to SEQ ID NO: 100366
  misc_feature 1..30: note = chr9:130256609-130256639
  misc_feature 1..30: note = Hypo
  source 1..30: mol_type = genomic DNA

SEQ ID NO: 131107 - DNA, 20 bp, Homo sapiens
  misc_feature 1..20: note = chr9:130262351-130262371
  misc_feature 1..20: note = Hypo
  source 1..20: mol_type = genomic DNA
cttagcagccgggcacgttg

SEQ ID NO: 131108 - DNA, 35 bp, Homo sapiens; identical to SEQ ID NO: 100368
  misc_feature 1..35: note = chr9:130326063-130326098
  misc_feature 1..35: note = Hypo
  source 1..35: mol_type = genomic DNA

SEQ ID NO: 131109 - DNA, 50 bp, Homo sapiens; identical to SEQ ID NO: 100369
  misc_feature 1..50: note = chr9:130362069-130362119
  misc_feature 1..50: note = Hypo
  source 1..50: mol_type = genomic DNA

SEQ ID NO: 131110 - DNA, 328 bp, Homo sapiens
  misc_feature 1..328: note = chr9:130461603-130461931
  misc_feature 1..328: note = Hyper
  source 1..328: mol_type = genomic DNA
accgacactcgaggccgaaacactgtgagcaaggaaaaggccgacacccaacaccggtcacgcggcggatcagacgcggcctcgggactgggcttggggaggccgggcttccggggctagtaagcgtctactagccgggctgtttagggattggtcgcctctggccctggaggcgggggttcctggagtaagacggttgctgattggctggctttccgaggcggggttgtgaagcgttggtcattctatctgggtgctgggttaggcagtacgaatactaaaattggaaccagtgacacgcagattggtgaagcgttccatatttttt

SEQ ID NO: 131111 - DNA, 27 bp, Homo sapiens
  misc_feature 1..27: note = chr9:130505479-130505506
  misc_feature 1..27: note = Hypo
  source 1..27: mol_type = genomic DNA
ttaaatattcagttacggtcggccggg

SEQ ID NO: 131112 - DNA, 30 bp, Homo sapiens; identical to SEQ ID NO: 42222
  misc_feature 1..30: note = chr9:130534900-130534930
  misc_feature 1..30: note = Hypo
  source 1..30: mol_type = genomic DNA

SEQ ID NO: 131113 - DNA, 30 bp, Homo sapiens; identical to SEQ ID NO: 100373
  misc_feature 1..30: note = chr9:130587535-130587565
  misc_feature 1..30: note = Hypo
  source 1..30: mol_type = genomic DNA

SEQ ID NO: 131114 - DNA, 34 bp, Homo sapiens; identical to SEQ ID NO: 100374
  misc_feature 1..34: note = chr9:130639978-130640012
  misc_feature 1..34: note = Hyper
  source 1..34: mol_type = genomic DNA

SEQ ID NO: 131115 - DNA, 93 bp, Homo sapiens; identical to SEQ ID NO: 100375
  misc_feature 1..93: note = chr9:130676150-130676243
  misc_feature 1..93: note = Hypo
  source 1..93: mol_type = genomic DNA

SEQ ID NO: 131116 - DNA, 224 bp, Homo sapiens
  misc_feature 1..224: note = chr9:130689420-130689644
  misc_feature 1..224: note = Hyper
  source 1..224: mol_type = genomic DNA
aggccactcacctctcggagatgcggccggcggggtagaagacgctctgcatgacgatgaagtacgtctgggggccgggacagggagtgagggaggccggctgtcgccctccagccgcccgctccgcccagccacctcgcctcggcttcacccaccttctttccccggtccacccgcagactgtgcactcctggaaggggagagggcgccggatgaggatcccc

SEQ ID NO: 131117 - DNA, 125 bp, Homo sapiens; identical to SEQ ID NO: 100378
  misc_feature 1..125: note = chr9:130828878-130829003
  misc_feature 1..125: note = Hypo
  source 1..125: mol_type = genomic DNA

SEQ ID NO: 131118 - DNA, 30 bp, Homo sapiens; identical to SEQ ID NO: 42224
  misc_feature 1..30: note = chr9:130857460-130857490
  misc_feature 1..30: note = Hypo
  source 1..30: mol_type = genomic DNA

SEQ ID NO: 131119 - DNA, 30 bp, Homo sapiens; identical to SEQ ID NO: 100380
  misc_feature 1..30: note = chr9:130870626-130870656
  misc_feature 1..30: note = Hypo
  source 1..30: mol_type = genomic DNA

SEQ ID NO: 131120 - DNA, 30 bp, Homo sapiens; identical to SEQ ID NO: 100381
  misc_feature 1..30: note = chr9:130908223-130908253
  misc_feature 1..30: note = Hypo
  source 1..30: mol_type = genomic DNA

SEQ ID NO: 131121 - DNA, 30 bp, Homo sapiens; identical to SEQ ID NO: 100382
  misc_feature 1..30: note = chr9:130980679-130980709
  misc_feature 1..30: note = Hypo
  source 1..30: mol_type = genomic DNA

SEQ ID NO: 131122 - DNA, 21 bp, Homo sapiens
  misc_feature 1..21: note = chr9:131060946-131060967
  misc_feature 1..21: note = Hypo
  source 1..21: mol_type = genomic DNA
ccaccgcgcctggccccttgg

SEQ ID NO: 131123 - DNA, 30 bp, Homo sapiens; identical to SEQ ID NO: 100384
  misc_feature 1..30: note = chr9:131083970-131084000
  misc_feature 1..30: note = Hypo
  source 1..30: mol_type = genomic DNA

SEQ ID NO: 131124 - DNA, 109 bp, Homo sapiens; identical to SEQ ID NO: 100385
  misc_feature 1..109: note = chr9:131095776-131095885
  misc_feature 1..109: note = Hypo
  source 1..109: mol_type = genomic DNA

SEQ ID NO: 131125 - DNA, 115 bp, Homo sapiens; identical to SEQ ID NO: 32725
  misc_feature 1..115: note = chr9:131127226-131127341
  misc_feature 1..115: note = Hyper
  source 1..115: mol_type = genomic DNA

SEQ ID NO: 131126 - DNA, 210 bp, Homo sapiens; identical to SEQ ID NO: 100387
  misc_feature 1..210: note = chr9:131159439-131159649
  misc_feature 1..210: note = Hyper
  source 1..210: mol_type = genomic DNA

SEQ ID NO: 131127 - DNA, 167 bp, Homo sapiens; identical to SEQ ID NO: 100388
  misc_feature 1..167: note = chr9:131217228-131217395
  misc_feature 1..167: note = Hypo
  source 1..167: mol_type = genomic DNA

SEQ ID NO: 131128 - DNA, 42 bp, Homo sapiens; identical to SEQ ID NO: 100389
  misc_feature 1..42: note = chr9:131399249-131399291
  misc_feature 1..42: note = Hypo
  source 1..42: mol_type = genomic DNA

SEQ ID NO: 131129 - DNA, 24 bp, Homo sapiens
  misc_feature 1..24: note = chr9:131417485-131417509
  misc_feature 1..24: note = Hypo
  source 1..24: mol_type = genomic DNA
aaagttagcctgggccggcgcggt

SEQ ID NO: 131130 - DNA, 278 bp, Homo sapiens; identical to SEQ ID NO: 42228
  misc_feature 1..278: note = chr9:131504870-131505148
  misc_feature 1..278: note = Hypo
  source 1..278: mol_type = genomic DNA

SEQ ID NO: 131131 - DNA, 105 bp, Homo sapiens; identical to SEQ ID NO: 42229
  misc_feature 1..105: note = chr9:131579999-131580104
  misc_feature 1..105: note = Hypo
  source 1..105: mol_type = genomic DNA

SEQ ID NO: 131132 - DNA, 30 bp, Homo sapiens; identical to SEQ ID NO: 100393
  misc_feature 1..30: note = chr9:131607517-131607547
  misc_feature 1..30: note = Hypo
  source 1..30: mol_type = genomic DNA

SEQ ID NO: 131133 - DNA, 30 bp, Homo sapiens; identical to SEQ ID NO: 100394
  misc_feature 1..30: note = chr9:131607770-131607800
  misc_feature 1..30: note = Hypo
  source 1..30: mol_type = genomic DNA

SEQ ID NO: 131134 - DNA, 30 bp, Homo sapiens; identical to SEQ ID NO: 100395
  misc_feature 1..30: note = chr9:131652716-131652746
  misc_feature 1..30: note = Hypo
  source 1..30: mol_type = genomic DNA

SEQ ID NO: 131135 - DNA, 24 bp, Homo sapiens
  misc_feature 1..24: note = chr9:131693810-131693834
  misc_feature 1..24: note = Hypo
  source 1..24: mol_type = genomic DNA
cttttttttttgagacggagtctc

SEQ ID NO: 131136 - DNA, 17 bp, Homo sapiens
  misc_feature 1..17: note = chr9:131814818-131814835
  misc_feature 1..17: note = Hypo
  source 1..17: mol_type = genomic DNA
gccgaggcaggaggacc

SEQ ID NO: 131137 - DNA, 35 bp, Homo sapiens; identical to SEQ ID NO: 100398
  misc_feature 1..35: note = chr9:131821609-131821644
  misc_feature 1..35: note = Hypo
  source 1..35: mol_type = genomic DNA

SEQ ID NO: 131138 - DNA, 162 bp, Homo sapiens; identical to SEQ ID NO: 100399
  misc_feature 1..162: note = chr9:131822028-131822190
  misc_feature 1..162: note = Hypo
  source 1..162: mol_type = genomic DNA

SEQ ID NO: 131139 - DNA, 69 bp, Homo sapiens; identical to SEQ ID NO: 100400
  misc_feature 1..69: note = chr9:131842877-131842946
  misc_feature 1..69: note = Hyper
  source 1..69: mol_type = genomic DNA

SEQ ID NO: 131140 - DNA, 420 bp, Homo sapiens; identical to SEQ ID NO: 100401
  misc_feature 1..420: note = chr9:131854046-131854466
  misc_feature 1..420: note = Hypo
  source 1..420: mol_type = genomic DNA

SEQ ID NO: 131141 - DNA, 91 bp, Homo sapiens; identical to SEQ ID NO: 100402
  misc_feature 1..91: note = chr9:131868867-131868958
  misc_feature 1..91: note = Hypo
  source 1..91: mol_type = genomic DNA

SEQ ID NO: 131142 - DNA, 118 bp, Homo sapiens; identical to SEQ ID NO: 100403
  misc_feature 1..118: note = chr9:131870288-131870406
  misc_feature 1..118: note = Hypo
  source 1..118: mol_type = genomic DNA

SEQ ID NO: 131143 - DNA, 462 bp, Homo sapiens
  misc_feature 1..462: note = chr9:131872458-131872920
  misc_feature 1..462: note = Hyper
  source 1..462: mol_type = genomic DNA
gtctctctcccctaccggcctgtctctgggtctaagggtgggggtgctaactgaagccggggtcccccttgtctttcctgggtcgttggaactgaatgctccaggacgtgggtttaatcccgcttctgaccttgcgccccaatctcctgctctgccaaacctgggacgcccgcctgaccccaccccatcagctggaggccgggtcgaacagcggccgcaggacgcggtctccgttcccggacgcaaccgcacggcccgcccaggccgtccagggccctcaggcccgggatccgccgcactcaccacggtcctggcagcgaaggctaacatcttcgctgcccgtccgcggacacgcagtccgctccgccccacacaccgggcaaagtccgcgccgccgccgccgcggctggggtcggtgggtccttgctagagccttcgggccaaggtcgctgagttacagcc

SEQ ID NO: 131144 - DNA, 26 bp, Homo sapiens
  misc_feature 1..26: note = chr9:132000549-132000575
  misc_feature 1..26: note = Hypo
  source 1..26: mol_type = genomic DNA
atcctctcccatgtgcgccttctctt

SEQ ID NO: 131145 - DNA, 193 bp, Homo sapiens; identical to SEQ ID NO: 100407
  misc_feature 1..193: note = chr9:132020917-132021110
  misc_feature 1..193: note = Hyper
  source 1..193: mol_type = genomic DNA

SEQ ID NO: 131146 - DNA, 144 bp, Homo sapiens; identical to SEQ ID NO: 42233
  misc_feature 1..144: note = chr9:132040507-132040651
  misc_feature 1..144: note = Hypo
  source 1..144: mol_type = genomic DNA

SEQ ID NO: 131147 - DNA, 35 bp, Homo sapiens; identical to SEQ ID NO: 100409
  misc_feature 1..35: note = chr9:132114141-132114176
  misc_feature 1..35: note = Hyper
  source 1..35: mol_type = genomic DNA

SEQ ID NO: 131148 - DNA, 30 bp, Homo sapiens; identical to SEQ ID NO: 100410
  misc_feature 1..30: note = chr9:132114392-132114422
  misc_feature 1..30: note = Hyper
  source 1..30: mol_type = genomic DNA

SEQ ID NO: 131149 - DNA, 75 bp, Homo sapiens; identical to SEQ ID NO: 100411
  misc_feature 1..75: note = chr9:132197706-132197781
  misc_feature 1..75: note = Hypo
  source 1..75: mol_type = genomic DNA

SEQ ID NO: 131150 - DNA, 30 bp, Homo sapiens; identical to SEQ ID NO: 100412
  misc_feature 1..30: note = chr9:132200261-132200291
  misc_feature 1..30: note = Hyper
  source 1..30: mol_type = genomic DNA

SEQ ID NO: 131151 - DNA, 42 bp, Homo sapiens; identical to SEQ ID NO: 100413
  misc_feature 1..42: note = chr9:132244699-132244741
  misc_feature 1..42: note = Hyper
  source 1..42: mol_type = genomic DNA

SEQ ID NO: 131152 - DNA, 50 bp, Homo sapiens; identical to SEQ ID NO: 100414
  misc_feature 1..50: note = chr9:132245295-132245345
  misc_feature 1..50: note = Hyper
  source 1..50: mol_type = genomic DNA

SEQ ID NO: 131153 - DNA, 18 bp, Homo sapiens
  misc_feature 1..18: note = chr9:132257308-132257326
  misc_feature 1..18: note = Hypo
  source 1..18: mol_type = genomic DNA
acccggcaacagaacata

SEQ ID NO: 131154 - DNA, 23 bp, Homo sapiens
  misc_feature 1..23: note = chr9:132268469-132268492
  misc_feature 1..23: note = Hypo
  source 1..23: mol_type = genomic DNA
ttggcctgcgataaaattgcaca

SEQ ID NO: 131155 - DNA, 105 bp, Homo sapiens; identical to SEQ ID NO: 100417
  misc_feature 1..105: note = chr9:132331231-132331336
  misc_feature 1..105: note = Hyper
  source 1..105: mol_type = genomic DNA

SEQ ID NO: 131156 - DNA, 456 bp, Homo sapiens; identical to SEQ ID NO: 100418
  misc_feature 1..456: note = chr9:132359682-132360138
  misc_feature 1..456: note = Hyper
  source 1..456: mol_type = genomic DNA

SEQ ID NO: 131157 - DNA, 822 bp, Homo sapiens
  misc_feature 1..822: note = chr9:132382195-132383017
  misc_feature 1..822: note = Hyper
  source 1..822: mol_type = genomic DNA
ctcaaggacgggttgcgagggctctgagatactcagctaacattagcatccttctagcctgggtggtggggtggtgggtgcggggacacaagggaccaccccccaccggaaatgactcgggcccgccccccgggccccgcggggcctcactcagtggctccggctcctcggcgcacttctcctggagctggtgcaggaactcacggaacctgctggggaggagctctcctaggaaggcgcccaagaagtcggggtcctccctggccacgcgcctccgggggcgctcgcgctctccaggccctggctgcctgggcgccgattcccgggacgcgccggccgacagcaggggaggcggcagcagggaccgcagcagcccccgcttccgcacggcccgccgggtcgcggtgagcaaggcgggcaggcgcggcgggaggcgtccgacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccgggcggggcagcgcggtgcggggtgaacgccaccggcccggcggacagcgagtggcttcaggc

SEQ ID NO: 131158 - DNA, 235 bp, Homo sapiens; identical to SEQ ID NO: 100421
  misc_feature 1..235: note = chr9:132402075-132402310
  misc_feature 1..235: note = Hypo
  source 1..235: mol_type = genomic DNA

SEQ ID NO: 131159 - DNA, 485 bp, Homo sapiens; identical to SEQ ID NO: 100422
  misc_feature 1..485: note = chr9:132402755-132403240
  misc_feature 1..485: note = Hypo
  source 1..485: mol_type = genomic DNA

SEQ ID NO: 131160 - DNA, 71 bp, Homo sapiens
  misc_feature 1..71: note = chr9:132427621-132427692
  misc_feature 1..71: note = Hyper
  source 1..71: mol_type = genomic DNA
tgggagtggggggctcgtcgccttcgtctctgggccgccccctccacctgcggaggcgattgtaaagggaa

SEQ ID NO: 131161 - DNA, 71 bp, Homo sapiens; identical to SEQ ID NO: 32732
  misc_feature 1..71: note = chr9:132428052-132428123
  misc_feature 1..71: note = Hyper
  source 1..71: mol_type = genomic DNA

SEQ ID NO: 131162 - DNA, 277 bp, Homo sapiens; identical to SEQ ID NO: 100426
  misc_feature 1..277: note = chr9:132428401-132428678
  misc_feature 1..277: note = Hyper
  source 1..277: mol_type = genomic DNA

SEQ ID NO: 131163 - DNA, 392 bp, Homo sapiens; identical to SEQ ID NO: 100427
  misc_feature 1..392: note = chr9:132459541-132459933
  misc_feature 1..392: note = Hyper
  source 1..392: mol_type = genomic DNA

SEQ ID NO: 131164 - DNA, 93 bp, Homo sapiens; identical to SEQ ID NO: 42235
  misc_feature 1..93: note = chr9:132491528-132491621
  misc_feature 1..93: note = Hypo
  source 1..93: mol_type = genomic DNA

SEQ ID NO: 131165 - DNA, 37 bp, Homo sapiens; identical to SEQ ID NO: 100429
  misc_feature 1..37: note = chr9:132513020-132513057
  misc_feature 1..37: note = Hypo
  source 1..37: mol_type = genomic DNA

SEQ ID NO: 131166 - DNA, 30 bp, Homo sapiens; identical to SEQ ID NO: 100430
  misc_feature 1..30: note = chr9:132523662-132523692
  misc_feature 1..30: note = Hypo
  source 1..30: mol_type = genomic DNA

SEQ ID NO: 131167 - DNA, 120 bp, Homo sapiens; identical to SEQ ID NO: 100431
  misc_feature 1..120: note = chr9:132559293-132559413
  misc_feature 1..120: note = Hypo
  source 1..120: mol_type = genomic DNA

SEQ ID NO: 131168 - DNA, 30 bp, Homo sapiens; identical to SEQ ID NO: 100432
  misc_feature 1..30: note = chr9:132643791-132643821
  misc_feature 1..30: note = Hypo
  source 1..30: mol_type = genomic DNA

SEQ ID NO: 131169 - DNA, 161 bp, Homo sapiens; identical to SEQ ID NO: 100433
  misc_feature 1..161: note = chr9:132691954-132692115
  misc_feature 1..161: note = Hypo
  source 1..161: mol_type = genomic DNA

SEQ ID NO: 131170 - DNA, 30 bp, Homo sapiens; identical to SEQ ID NO: 100438
  misc_feature 1..30: note = chr9:132805344-132805374
  misc_feature 1..30: note = Hyper
  source 1..30: mol_type = genomic DNA

SEQ ID NO: 131171 - DNA, 48 bp, Homo sapiens; identical to SEQ ID NO: 100439
  misc_feature 1..48: note = chr9:132805845-132805893
  misc_feature 1..48: note = Hyper
  source 1..48: mol_type = genomic DNA

SEQ ID NO: 131172 - DNA, 120 bp, Homo sapiens; identical to SEQ ID NO: 100440
  misc_feature 1..120: note = chr9:132815000-132815120
  misc_feature 1..120: note = Hypo
  source 1..120: mol_type = genomic DNA

SEQ ID NO: 131173 - DNA, 100 bp, Homo sapiens; identical to SEQ ID NO: 100441
  misc_feature 1..100: note = chr9:132881395-132881495
  misc_feature 1..100: note = Hypo
  source 1..100: mol_type = genomic DNA

SEQ ID NO: 131174 - DNA, 30 bp, Homo sapiens; identical to SEQ ID NO: 100442
  misc_feature 1..30: note = chr9:133267430-133267460
  misc_feature 1..30: note = Hypo
  source 1..30: mol_type = genomic DNA

SEQ ID NO: 131175 - DNA, 30 bp, Homo sapiens; identical to SEQ ID NO: 100443
  misc_feature 1..30: note = chr9:133270785-133270815
  misc_feature 1..30: note = Hypo
  source 1..30: mol_type = genomic DNA

SEQ ID NO: 131176 - DNA, 216 bp, Homo sapiens; identical to SEQ ID NO: 100444
  misc_feature 1..216: note = chr9:133308836-133309052
  misc_feature 1..216: note = Hyper
  source 1..216: mol_type = genomic DNA

SEQ ID NO: 131177 - DNA, 36 bp, Homo sapiens; identical to SEQ ID NO: 100445
  misc_feature 1..36: note = chr9:133319966-133320002
  misc_feature 1..36: note = Hyper
  source 1..36: mol_type = genomic DNA

SEQ ID NO: 131178 - DNA, 367 bp, Homo sapiens; identical to SEQ ID NO: 100446
  misc_feature 1..367: note = chr9:133320407-133320774
  misc_feature 1..367: note = Hyper
  source 1..367: mol_type = genomic DNA

SEQ ID NO: 131179 - DNA, 30 bp, Homo sapiens; identical to SEQ ID NO: 100447
  misc_feature 1..30: note = chr9:133366620-133366650
  misc_feature 1..30: note = Hypo
  source 1..30: mol_type = genomic DNA

SEQ ID NO: 131180 - DNA, 23 bp, Homo sapiens
  misc_feature 1..23: note = chr9:133409075-133409098
  misc_feature 1..23: note = Hypo
  source 1..23: mol_type = genomic DNA
ttttttttttttagacggagtct

SEQ ID NO: 131181 - DNA, 86 bp, Homo sapiens; identical to SEQ ID NO: 100449
  misc_feature 1..86: note = chr9:133506386-133506472
  misc_feature 1..86: note = Hypo
  source 1..86: mol_type = genomic DNA

SEQ ID NO: 131182 - DNA, 30 bp, Homo sapiens; identical to SEQ ID NO: 42237
  misc_feature 1..30: note = chr9:133510031-133510061
  misc_feature 1..30: note = Hypo
  source 1..30: mol_type = genomic DNA

SEQ ID NO: 131183 - DNA, 161 bp, Homo sapiens; identical to SEQ ID NO: 100451
  misc_feature 1..161: note = chr9:133518349-133518510
  misc_feature 1..161: note = Hypo
  source 1..161: mol_type = genomic DNA

SEQ ID NO: 131184 - DNA, 4655 bp, Homo sapiens
  misc_feature 1..4655: note = chr9:133534565-133539220
  misc_feature 1..4655: note = Hyper
  source 1..4655: mol_type = genomic DNA
tgcttccttcatctccgagtctttgtacccctgcgtctccgactcggcctttcatctgctccctccacctcggcatcgccttgcctcagtctcccccgacccctgtctcgccccctctgcttccagaagcctgcgcctctgtctctcccaccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcctacgcactccacgtgggcgccccggggcgcgcctttgtctctcccgagccttgaaagctaattacattgggaggggacaggggtggggtgggagagggggccgctgtccccattcactgagccgaggccgccactccgccggcagccccgcgcaggcctggccccgagtcacgtctgttgaaaccgtttttttcggcctcgcccccacccgccttggcagccagccgcgcctttgtacgcgccggcgggggcgccctggaaccctgaaccgtcttacggggaacgggggtggggggaggggagcggcgcgggccccacgcgaggaaggaatttcctgggccactgcgaaagattgaggctcagaaagccagagagagacgtgcgaggaggaagcggagagggtgtgcgaagctggagagggagtcggagcgccagcgaaagaggggagcgctggggaaggaggaagagaaggagagggggagaagagagacgcggatgctgggcgcgcgacggcagcgggcggaggaggggagcggccgggaacctgcgcgcaggggaagccaggacggagcgcagcaccggcaggggagggttgccgaggggctgtgccgaggagcccgggtgggggcggctggaccgcgggccgcgggactcacagacagtgcgaggcggcgcgggggcccctctccctatgcggggctggggcgcaggggctgggcggggcgggtgggcgtctgagcgcggcgcgggcgcattcttcgccttttcttcctcgggctcattccggccgatcgatacctgcgcgggacctgcccccgccgctaatatctttttaatgagttcgccaggcttaaagcgagcgcgatctgccctccagggtggattttcccccggcagatgtttcgggaggaggaggcgcgcggagctcccgggaggggggacaaatctctccctccgaggggcgagaacaggagactttcttctaaagttcaaaagaaagacgggctttcactcggcccccaaaaatgtatttctcggcggacaatgggcttctttctgcgcctctgagggccggcggggcgggcagggcggggacccgtgcgctttggccccgcctgaccgactcgcacccccctcccccgcacccaggcccgggccccagagcgagggcgcaggagccgcgaagccggccgcccttccgagcgtccccctgaagcgcactgtcgggacctggctctcccggagctaagccccggcgcaccggcgagaacgaaagcgtcgtgcggggccctgggctgtcccacacgcccccgttctcataggtgcctcagccgggccgaagggacgcgcgctggtgcctcaaggggaggacgaacggacctccgggcttgggccgcggcctccttcccctcggcgctccgccctgagcggggcaacaactagaaattagccaaccccgggcggctgccgggccctgagactgtcttgcccgccccggcccagccacccctccgggtcgcccctgctcttctcctccacttccccttcaatgtccctccgtggggccgtcggcctgccgcggcggccctctctccactcccgtgggctcaggggaagagggcacccgggcggcgaggatgacctccgaagagccgcggcaaattgattcgttccgcccggagccggggccgcgtgaatgggggcccgggcggcggcggcagcggagaagaggataaagatgttctccctgaaagggggagggggcgcggagcgggaagcggggccattcactcctggcccggcccctcgggaagccgcgccgaagaaagggggccgaggcctattcaagtcctacgagccgcccacaatggaccgatatactgagggcctctctattaacgcccatgaatattaaagagatcgccaagtggcggccagcgggcgaggggggcgacggagcctgagagctccggcccggccgaggggagggggcttttgcgcgagcacattccgcgcctgggccccgcggaaaatgacaaaataacacgggtcatccgctgggaaagcccggaatgtttcccctcgaaatctcctcccggggagatgtgagcacagggtcttgctccctatttcaatgcaccttgagactgggcgctacctacgggctcctttttccccgggcgggggtccaggtgggttttgccgctagactagaagcacaaaatgtgagcgcggtggagatttgggcgcaccagctgggaggacgttctgcgctccgcttctgcccggctcccagtactgctctccgggcttgcgggtccggaggagaggaatgggactccctggccgcagtccgagcccgtggtcactgcgccagcggaatccaagcctctaactctaagccggggttcaggacccaaacgctgcaccccagcacggaggatgcacagacctgagggcttcccgcagtgggacgtggccctggagagggcaaaatcctcggggttgtcgtggggtaaagtgatcttacccaaagagagaccaagcaaagaaacctcagttcacaaagtccaactcaaaccattgcacagacagggacaccgaggcccagagaggaaaggggcagtccacaggacacacagcagtccttatccccctttggtgtcctggaggaactgaggtcgctttcggggcttgggagctgccgcagcgcttggctcctggcagcgctccccgacgtcgtctccctcgctcctagcactttgtcctctccacctaggtcttcccagaagccaagaagtaggccccggtgaggctcccctgcaggagccatcggactccatacgccccctcagactcgagctctggccagggagccgatgcgacccacaagctgcgtcgaaaaatgagtggagggttcggcgaccctaacccacctccctcctcagcagcgctgccctctgctggcgccctgcccaacggtcctgccttctgccaggtgtgcccttccttgggctccagcctcgggcggacccggacgcagggtctgaaggccagctaccgccgccttcctccctttgcgtcccaacggggacgggggatgccggagactactggcaggaactggggaccaggggtctggagtctggacgccaggtgtgagaccctcttagccaaggcgcgtccgggtggtggaggggcgtctatgccaacaggcgtttggacagggtctcgctcatgggaggtcagctcgctgttcttccacccaagtcctccgcgctgaggagaaggtctagggagtccacacagtccagcggagactaatccgtgagcctgacccacgccgagagggtccaggcacctctgttagcggcatctgaaattgtaggctggtgatgggagccagaagtgcggcaggtggggtgagctccctcacccagcatgtcagggcctggggtccgaggcttgaggctgacactggggagccgcgaagcctgcaggaagcggggccttccgctgggctcagcagctacctgcttcgggagaggggatcgctgggctccgaggtgcctcgaaaccgccgcaaagcaagtctgctcctgggatgatgggcaggaggaatagaggagaggaagggaaagaagagagaggcagaggagaaagaaagaactaggaggcaagaaggaaggggcgccgcaacgccaccggcttcccgaggttgcagctcagcaaggagccggaaagccgggccgcaagccgaacccgcactgaggcctctcgcggagctgcctgcagtttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggggagggagagcggtgcagggctgggccggccagccggggca

SEQ ID NO: 131185 - DNA, 1010 bp, Homo sapiens
  misc_feature 1..1010: note = chr9:133539486-133540496
  misc_feature 1..1010: note = Hyper
  source 1..1010: mol_type = genomic DNA
gggtactgtttggagcggtccgcgcgcccccgcccctcgcgctctcgcgacgaaggctcctcgagcccagccgggtacaacaagtctgtcctccgacgtcagggggtcattaataaccaattaggagggtcactgcggctcctataaaggcgctgagattttgccaaggggaagacggccccggccgagtgtgcgagaggctagcgcgcgcctgagccccttgctgccgcttccctgcaaccacccgcctctcacccaccctgcaccccccgcacccgcctccgcctccacccgcgtctctccaccctccgcgccgcctttgccatctctacagatttcaccatctctcttcccctctccccctcgttcgctttcctcccagtcgccccctcacctcccgctccctcctgcgtcctcctcctctccgtcctccccctgctctggttccttctccatcgcagcgctctcctctcgccccttgggctcccctctcgcccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcaccgccgaggtgctggcgcagtccttctccggcggtgagtccagccgtcggagcccggcgcaatccctcctcccggcgacccccattcccgtcctggcgatgcgcgagacgcggctgggatacccggcctcgctgctactcgcgccaacctgggctctcccggcgctcggtgcacctcagtttccccatgggccaaaccaggacgcgagccaccaagcagctccgcagcccacccggctcaaggaccgaccccggcgaccccgtcgc

SEQ ID NO: 131186 - DNA, 1363 bp, Homo sapiens; identical to SEQ ID NO: 100459
  misc_feature 1..1363: note = chr9:133541059-133542422
  misc_feature 1..1363: note = Hyper
  source 1..1363: mol_type = genomic DNA

SEQ ID NO: 131187 - DNA, 90 bp, Homo sapiens; identical to SEQ ID NO: 100460
  misc_feature 1..90: note = chr9:133550849-133550939
  misc_feature 1..90: note = Hypo
  source 1..90: mol_type = genomic DNA

SEQ ID NO: 131188 - DNA, 16 bp, Homo sapiens
  misc_feature 1..16: note = chr9:133585587-133585603
  misc_feature 1..16: note = Hypo
  source 1..16: mol_type = genomic DNA
gcgactgagcgagact

SEQ ID NO: 131189 - DNA, 24 bp, Homo sapiens
  misc_feature 1..24: note = chr9:133604058-133604082
  misc_feature 1..24: note = Hypo
  source 1..24: mol_type = genomic DNA
gagccactgcgcccagcctgtttt

SEQ ID NO: 131190 - DNA, 69 bp, Homo sapiens; identical to SEQ ID NO: 100463
  misc_feature 1..69: note = chr9:133767809-133767878
  misc_feature 1..69: note = Hypo
  source 1..69: mol_type = genomic DNA

SEQ ID NO: 131191 - DNA, 30 bp, Homo sapiens; identical to SEQ ID NO: 100464
  misc_feature 1..30: note = chr9:133772234-133772264
  misc_feature 1..30: note = Hypo
  source 1..30: mol_type = genomic DNA

SEQ ID NO: 131192 - DNA, 30 bp, Homo sapiens; identical to SEQ ID NO: 100465
  misc_feature 1..30: note = chr9:133772670-133772700
  misc_feature 1..30: note = Hypo
  source 1..30: mol_type = genomic DNA

SEQ ID NO: 131193 - DNA, 367 bp, Homo sapiens; identical to SEQ ID NO: 100466
  misc_feature 1..367: note = chr9:133773692-133774059
  misc_feature 1..367: note = Hypo
  source 1..367: mol_type = genomic DNA

SEQ ID NO: 131194 - DNA, 38 bp, Homo sapiens; identical to SEQ ID NO: 100467
  misc_feature 1..38: note = chr9:133777251-133777289
  misc_feature 1..38: note = Hypo
  source 1..38: mol_type = genomic DNA

SEQ ID NO: 131195 - DNA, 611 bp, Homo sapiens; identical to SEQ ID NO: 100468
  misc_feature 1..611: note = chr9:133779336-133779947
  misc_feature 1..611: note = Hypo
  source 1..611: mol_type = genomic DNA

SEQ ID NO: 131196 - DNA, 44 bp, Homo sapiens; identical to SEQ ID NO: 100469
  misc_feature 1..44: note = chr9:133782143-133782187
  misc_feature 1..44: note = Hypo
  source 1..44: mol_type = genomic DNA

SEQ ID NO: 131197 - DNA, 72 bp, Homo sapiens; identical to SEQ ID NO: 100470
  misc_feature 1..72: note = chr9:133787196-133787268
  misc_feature 1..72: note = Hypo
  source 1..72: mol_type = genomic DNA

SEQ ID NO: 131198 - DNA, 48 bp, Homo sapiens; identical to SEQ ID NO: 100471
  misc_feature 1..48: note = chr9:133788368-133788416
  misc_feature 1..48: note = Hypo
  source 1..48: mol_type = genomic DNA

SEQ ID NO: 131199 - DNA, 30 bp, Homo sapiens; identical to SEQ ID NO: 100472
  misc_feature 1..30: note = chr9:133794635-133794665
  misc_feature 1..30: note = Hypo
  source 1..30: mol_type = genomic DNA

SEQ ID NO: 131200 - DNA, 81 bp, Homo sapiens; identical to SEQ ID NO: 100473
  misc_feature 1..81: note = chr9:133799115-133799196
  misc_feature 1..81: note = Hypo
  source 1..81: mol_type = genomic DNA

SEQ ID NO: 131201 - DNA, 30 bp, Homo sapiens; identical to SEQ ID NO: 100474
  misc_feature 1..30: note = chr9:133808587-133808617
  misc_feature 1..30: note = Hyper
  source 1..30: mol_type = genomic DNA

SEQ ID NO: 131202 - DNA, 34 bp, Homo sapiens; identical to SEQ ID NO: 100475
  misc_feature 1..34: note = chr9:133814201-133814235
  misc_feature 1..34: note = Hyper
  source 1..34: mol_type = genomic DNA

SEQ ID NO: 131203 - DNA, 70 bp, Homo sapiens; identical to SEQ ID NO: 100476
  misc_feature 1..70: note = chr9:133814841-133814911
  misc_feature 1..70: note = Hyper
  source 1..70: mol_type = genomic DNA

SEQ ID NO: 131204 - DNA, 70 bp, Homo sapiens; identical to SEQ ID NO: 100477
  misc_feature 1..70: note = chr9:133815217-133815287
  misc_feature 1..70: note = Hyper
  source 1..70: mol_type = genomic DNA

SEQ ID NO: 131205 - DNA, 30 bp, Homo sapiens; identical to SEQ ID NO: 100478
  misc_feature 1..30: note = chr9:133819170-133819200
  misc_feature 1..30: note = Hypo
  source 1..30: mol_type = genomic DNA

SEQ ID NO: 131206 - DNA, 33 bp, Homo sapiens; identical to SEQ ID NO: 100479
  misc_feature 1..33: note = chr9:133857774-133857807
  misc_feature 1..33: note = Hypo
  source 1..33: mol_type = genomic DNA

SEQ ID NO: 131207 - DNA, 64 bp, Homo sapiens; identical to SEQ ID NO: 42243
  misc_feature 1..64: note = chr9:133864850-133864914
  misc_feature 1..64: note = Hypo
  source 1..64: mol_type = genomic DNA

SEQ ID NO: 131208 - DNA, 189 bp, Homo sapiens; identical to SEQ ID NO: 42244
  misc_feature 1..189: note = chr9:133865355-133865544
  misc_feature 1..189: note = Hypo
  source 1..189: mol_type = genomic DNA

SEQ ID NO: 131209 - DNA, 577 bp, Homo sapiens; identical to SEQ ID NO: 100482
  misc_feature 1..577: note = chr9:133884368-133884945
  misc_feature 1..577: note = Hyper
  source 1..577: mol_type = genomic DNA

SEQ ID NO: 131210 - DNA, 90 bp, Homo sapiens; identical to SEQ ID NO: 100483
  misc_feature 1..90: note = chr9:133901867-133901957
  misc_feature 1..90: note = Hypo
  source 1..90: mol_type = genomic DNA

SEQ ID NO: 131211 - DNA, 65 bp, Homo sapiens; identical to SEQ ID NO: 100484
  misc_feature 1..65: note = chr9:133911658-133911723
  misc_feature 1..65: note = Hypo
  source 1..65: mol_type = genomic DNA

SEQ ID NO: 131212 - DNA, 134 bp, Homo sapiens; identical to SEQ ID NO: 100485
  misc_feature 1..134: note = chr9:133927347-133927481
  misc_feature 1..134: note = Hypo
  source 1..134: mol_type = genomic DNA

SEQ ID NO: 131213 - DNA, 66 bp, Homo sapiens; identical to SEQ ID NO: 100486
  misc_feature 1..66: note = chr9:133928206-133928272
  misc_feature 1..66: note = Hypo
  source 1..66: mol_type = genomic DNA

SEQ ID NO: 131214 - DNA, 241 bp, Homo sapiens; identical to SEQ ID NO: 100487
  misc_feature 1..241: note = chr9:133936538-133936779
  misc_feature 1..241: note = Hypo
  source 1..241: mol_type = genomic DNA

SEQ ID NO: 131215 - DNA, 30 bp, Homo sapiens; identical to SEQ ID NO: 100488
  misc_feature 1..30: note = chr9:133948389-133948419
  misc_feature 1..30: note = Hypo
  source 1..30: mol_type = genomic DNA

SEQ ID NO: 131216 - DNA, 30 bp, Homo sapiens; identical to SEQ ID NO: 100489
  misc_feature 1..30: note = chr9:133971630-133971660
  misc_feature 1..30: note = Hyper
  source 1..30: mol_type = genomic DNA

SEQ ID NO: 131217 - DNA, 190 bp, Homo sapiens; identical to SEQ ID NO: 100490
  misc_feature 1..190: note = chr9:133971948-133972138
  misc_feature 1..190: note = Hyper
  source 1..190: mol_type = genomic DNA

SEQ ID NO: 131218 - DNA, 31 bp, Homo sapiens; identical to SEQ ID NO: 42247
  misc_feature 1..31: note = chr9:134119973-134120004
  misc_feature 1..31: note = Hypo
  source 1..31: mol_type = genomic DNA

SEQ ID NO: 131219 - DNA, 28 bp, Homo sapiens
  misc_feature 1..28: note = chr9:134120951-134120979
  misc_feature 1..28: note = Hypo
  source 1..28: mol_type = genomic DNA
gggagagacccaccgatcctgtggggct

SEQ ID NO: 131220 - DNA, 30 bp, Homo sapiens; identical to SEQ ID NO: 100493
  misc_feature 1..30: note = chr9:134131898-134131928
  misc_feature 1..30: note = Hyper
  source 1..30: mol_type = genomic DNA

SEQ ID NO: 131221 - DNA, 126 bp, Homo sapiens; identical to SEQ ID NO: 42248
  misc_feature 1..126: note = chr9:134135879-134136005
  misc_feature 1..126: note = Hypo
  source 1..126: mol_type = genomic DNA

SEQ ID NO: 131222 - DNA, 94 bp, Homo sapiens; identical to SEQ ID NO: 100495
  misc_feature 1..94: note = chr9:134136231-134136325
  misc_feature 1..94: note = Hypo
  source 1..94: mol_type = genomic DNA

SEQ ID NO: 131223 - DNA, 753 bp, Homo sapiens; identical to SEQ ID NO: 100496
  misc_feature 1..753: note = chr9:134151929-134152682
  misc_feature 1..753: note = Hyper
  source 1..753: mol_type = genomic DNA

SEQ ID NO: 131224 - DNA, 225 bp, Homo sapiens; identical to SEQ ID NO: 32753
  misc_feature 1..225: note = chr9:134158243-134158468
  misc_feature 1..225: note = Hyper
  source 1..225: mol_type = genomic DNA

SEQ ID NO: 131225 - DNA, 142 bp, Homo sapiens; identical to SEQ ID NO: 100498
  misc_feature 1..142: note = chr9:134171926-134172068
  misc_feature 1..142: note = Hypo
  source 1..142: mol_type = genomic DNA

SEQ ID NO: 131226 - DNA, 25 bp, Homo sapiens
  misc_feature 1..25: note = chr9:134176645-134176670
  misc_feature 1..25: note = Hypo
  source 1..25: mol_type = genomic DNA
gcgctggcctcgaaaggcagatttt

SEQ ID NO: 131227 - DNA, 739 bp, Homo sapiens; identical to SEQ ID NO: 100500
  misc_feature 1..739: note = chr9:134191006-134191745
  misc_feature 1..739: note = Hypo
  source 1..739: mol_type = genomic DNA

SEQ ID NO: 131228 - DNA, 81 bp, Homo sapiens; identical to SEQ ID NO: 100501
  misc_feature 1..81: note = chr9:134207916-134207997
  misc_feature 1..81: note = Hypo
  source 1..81: mol_type = genomic DNA

SEQ ID NO: 131229 - DNA, 35 bp, Homo sapiens; identical to SEQ ID NO: 100502
  misc_feature 1..35: note = chr9:134421523-134421558
  misc_feature 1..35: note = Hyper
  source 1..35: mol_type = genomic DNA

SEQ ID NO: 131230 - DNA, 61 bp, Homo sapiens; identical to SEQ ID NO: 100503
  misc_feature 1..61: note = chr9:134421906-134421967
  misc_feature 1..61: note = Hyper
  source 1..61: mol_type = genomic DNA

SEQ ID NO: 131231 - DNA, 33 bp, Homo sapiens; identical to SEQ ID NO: 100504
  misc_feature 1..33: note = chr9:134648075-134648108
  misc_feature 1..33: note = Hypo
  source 1..33: mol_type = genomic DNA

SEQ ID NO: 131232 - DNA, 122 bp, Homo sapiens; identical to SEQ ID NO: 100505
  misc_feature 1..122: note = chr9:134717223-134717345
  misc_feature 1..122: note = Hypo
  source 1..122: mol_type = genomic DNA

SEQ ID NO: 131233 - DNA, 30 bp, Homo sapiens; identical to SEQ ID NO: 100506
  misc_feature 1..30: note = chr9:134717710-134717740
  misc_feature 1..30: note = Hypo
  source 1..30: mol_type = genomic DNA

SEQ ID NO: 131234 - DNA, 30 bp, Homo sapiens; identical to SEQ ID NO: 100507
  misc_feature 1..30: note = chr9:134718796-134718826
  misc_feature 1..30: note = Hypo
  source 1..30: mol_type = genomic DNA

SEQ ID NO: 131235 - DNA, 29 bp, Homo sapiens
  misc_feature 1..29: note = chr9:134723620-134723649
  misc_feature 1..29: note = Hypo
  source 1..29: mol_type = genomic DNA
gtgggtggctctgacgctaagactggcct

SEQ ID NO: 131236 - DNA, 30 bp, Homo sapiens; identical to SEQ ID NO: 42254
  misc_feature 1..30: note = chr9:134724244-134724274
  misc_feature 1..30: note = Hypo
  source 1..30: mol_type = genomic DNA

SEQ ID NO: 131237 - DNA, 416 bp, Homo sapiens; identical to SEQ ID NO: 100510
  misc_feature 1..416: note = chr9:134818649-134819065
  misc_feature 1..416: note = Hypo
  source 1..416: mol_type = genomic DNA

SEQ ID NO: 131238 - DNA, 341 bp, Homo sapiens; identical to SEQ ID NO: 100511
  misc_feature 1..341: note = chr9:134913048-134913389
  misc_feature 1..341: note = Hypo
  source 1..341: mol_type = genomic DNA

SEQ ID NO: 131239 - DNA, 30 bp, Homo sapiens; identical to SEQ ID NO: 100512
  misc_feature 1..30: note = chr9:134915848-134915878
  misc_feature 1..30: note = Hypo
  source 1..30: mol_type = genomic DNA

SEQ ID NO: 131240 - DNA, 30 bp, Homo sapiens; identical to SEQ ID NO: 100513
  misc_feature 1..30: note = chr9:135012697-135012727
  misc_feature 1..30: note = Hypo
  source 1..30: mol_type = genomic DNA

SEQ ID NO: 131241 - DNA, 30 bp, Homo sapiens; identical to SEQ ID NO: 42257
  misc_feature 1..30: note = chr9:135027845-135027875
  misc_feature 1..30: note = Hypo
  source 1..30: mol_type = genomic DNA

SEQ ID NO: 131242 - DNA, 860 bp, Homo sapiens
  misc_feature 1..860: note = chr9:135036580-135037440
  misc_feature 1..860: note = Hyper
  source 1..860: mol_type = genomic DNA
tccacccacccaccccggtacccactgcttggggccttctgggtggcagcacttcacagagagagaccgaggagcagccctgagcccttggctgtggggggtgggggaactgactcacttggcccccctccctcgtgccgatggggcagcccccacacccatgggcgctggcaccccggcaggcccccgggttttggaagaggaagctgcagcccggctgcgcctgaccggagccggctgaggatgcgctctgggcgcagggacccgctggcccccgggccgggaggcgatgtttaggcagcgaccccccagaggctgccggggccaccctggccacgggcccgccgggacgcccctgctcgccgcgcccctccccgggccgtggcgcgtcccccgagccgcgcaatatttccttcctgcacctttaagaagaccgttgctccgtggtgggatggtgtgttaaagccacacagaggaagttacgcagcccggatcagaccgagagataaaagccccgatggtgatcgtgagtgatggcaagaggatttagcctcggcattaacttggagcggagtgcaggggggcagtgaagcgcccgccatctggcccgcgccgcgccggggggatgccccggctccccgacgagacgccgcgaagcccacccgggccgggggctgcccggcgcccgagcgcgggtcctccccgggccgcccaggggggccaaaaagtttgcacttgttagcggcgacctcccgctcagcccgggcgggcgatgcgggcggcgcgggcggccccctcccccggcccgcgtctccgggacggctgcgggcggcccccccggcggccggagggctccctgg

SEQ ID NO: 131243 - DNA, 225 bp, Homo sapiens
  misc_feature 1..225: note = chr9:135038238-135038463
  misc_feature 1..225: note = Hyper
  source 1..225: mol_type = genomic DNA
gcactggtttggggccggcgtggagtcgaacctggaactgagcggcgcgcaggtggggggagcagaggcggcgggaaggcgggaagagaggaccgcgggctcgcggggtccgcccgctccggagtaagttggccgtctgggctgggggcggcggcggccgggtcgccacaggcggcagcgccggggcaaaggatacagccagttcctgggcgccctgctctgtgt

SEQ ID NO: 131244 - DNA, 30 bp, Homo sapiens; identical to SEQ ID NO: 42258
  misc_feature 1..30: note = chr9:135054774-135054804
  misc_feature 1..30: note = Hypo
  source 1..30: mol_type = genomic DNA

SEQ ID NO: 131245 - DNA, 17 bp, Homo sapiens
  misc_feature 1..17: note = chr9:135067234-135067251
  misc_feature 1..17: note = Hypo
  source 1..17: mol_type = genomic DNA
ggcgtgagccaccgcgc

SEQ ID NO: 131246 - DNA, 114 bp, Homo sapiens; identical to SEQ ID NO: 100521
  misc_feature 1..114: note = chr9:135091410-135091524
  misc_feature 1..114: note = Hypo
  source 1..114: mol_type = genomic DNA

SEQ ID NO: 131247 - DNA, 175 bp, Homo sapiens; identical to SEQ ID NO: 100522
  misc_feature 1..175: note = chr9:135102332-135102507
  misc_feature 1..175: note = Hypo
  source 1..175: mol_type = genomic DNA

SEQ ID NO: 131248 - DNA, 165 bp, Homo sapiens; identical to SEQ ID NO: 100523
  misc_feature 1..165: note = chr9:135116306-135116471
  misc_feature 1..165: note = Hyper
  source 1..165: mol_type = genomic DNA

SEQ ID NO: 131249 - DNA, 40 bp, Homo sapiens; identical to SEQ ID NO: 100524
  misc_feature 1..40: note = chr9:135118020-135118060
  misc_feature 1..40: note = Hyper
  source 1..40: mol_type = genomic DNA

SEQ ID NO: 131250 - DNA, 30 bp, Homo sapiens; identical to SEQ ID NO: 100525
  misc_feature 1..30: note = chr9:135121068-135121098
  misc_feature 1..30: note = Hypo
  source 1..30: mol_type = genomic DNA

SEQ ID NO: 131251 - DNA, 92 bp, Homo sapiens; identical to SEQ ID NO: 100526
  misc_feature 1..92: note = chr9:135129056-135129148
  misc_feature 1..92: note = Hypo
  source 1..92: mol_type = genomic DNA

SEQ ID NO: 131252 - DNA, 23 bp, Homo sapiens
  misc_feature 1..23: note = chr9:135135287-135135310
  misc_feature 1..23: note = Hypo
  source 1..23: mol_type = genomic DNA
caaaactccgtctcaaaaaaaca

SEQ ID NO: 131253 - DNA, 38 bp, Homo sapiens; identical to SEQ ID NO: 100528
  misc_feature 1..38: note = chr9:135230930-135230968
  misc_feature 1..38: note = Hypo
  source 1..38: mol_type = genomic DNA

SEQ ID NO: 131254 - DNA, 30 bp, Homo sapiens; identical to SEQ ID NO: 100529
  misc_feature 1..30: note = chr9:135239643-135239673
  misc_feature 1..30: note = Hypo
  source 1..30: mol_type = genomic DNA

SEQ ID NO: 131255 - DNA, 992 bp, Homo sapiens
  misc_feature 1..992: note = chr9:135285332-135286324
  misc_feature 1..992: note = Hyper
  source 1..992: mol_type = genomic DNA
ccgtcgccaaggagacgggccgttgcattcgtcctccaggggtggtcttggttttctttcctctcccagtctgcaacgcggggcccaggagacgccctgaggatcccgcggggctcctgcattgctccggggctctttgcgatgaggggccggcgcgagcggggcgcgcctggctccggaggggtcctggcatctgagtttccccctcaggatcccggtggtgcggcccgggccgcccggcaggcccttcggagctccaggctgtgcccgacgtggggaagcgcgcccaaaccagcccgcgggccggctccccggcgacctcaaggatgccagaggccaggagctccggcccggacctcacgcgatggaggaagcagcagcagcctgtgcgccgcacggtcagccaggtctgcccgcccccgcggcggcccctgaccgtggcggacatccgttccggcatggagaacgagcggctgggggtcgtgcgggactccatgtttcagaaccctctcatcgtcaaggtgagcaccccacgcccaccgcgctttcgctgtcgccggctccgggcacctgcgccgccgggggtccccacccgcagcgccctggccccgcggcccggggtccgagcgcagcgtgggaagctccagctctggtccagacaggcctggacccccatgcaggtcgcgtcgcctctctcagcctcggtttccccatcctcacagtgggatgataatggcaccactaaagggactgattgggaagattgaatagggtaatttctgcgggacctcgggacagcgcctgacatggggtaaggctgcaatgggtgctgctgtggtttcccacagagtgaacccacagggtgacagataggtcgcacacgcccagtctaagtcgtggctgccagccctcccagggtaaaggccgcctctccggttccgctgcacgcctggggtacgtctatgcagcggtggctccgtgtctgtcctgga

SEQ ID NO: 131256 - DNA, 68 bp, Homo sapiens; identical to SEQ ID NO: 100532
  misc_feature 1..68: note = chr9:135287745-135287813
  misc_feature 1..68: note = Hyper
  source 1..68: mol_type = genomic DNA

SEQ ID NO: 131257 - DNA, 39 bp, Homo sapiens; identical to SEQ ID NO: 100533
  misc_feature 1..39: note = chr9:135426974-135427013
  misc_feature 1..39: note = Hypo
  source 1..39: mol_type = genomic DNA

SEQ ID NO: 131258 - DNA, 1951 bp, Homo sapiens
  misc_feature 1..1951: note = chr9:135454985-135456936
  misc_feature 1..1951: note = Hyper
  source 1..1951: mol_type = genomic DNA
tggagctgggaatcccgaaatcggaataaaacgatgttattgagagagggctaaatcccagagtaaatttcaaacgaaataaatcgcacagcacattttagatgataatagacggcggtaactcaatactaatgatagtgtactgacaacccgctaatagtcttgggctccaagaagcccggcaaaaccggctggggcggcaggaggtccggctttggtgttctttcccaccgggagaggttggagccaccctcactcccggccgctctcaatcgatcgcagctcccttcgctcccaagcttcgctttcgctgggtccgggatccaaatcccaacccaagagccaaaggccagaaaaggccctggcgttgccagctgcttgtcgccctggggaggggcggctccggacccgcccggggcagaggaggacagagcggacgctctggggaccaggcggtcccgcgcatgcttggccaggggcatcgccgtggctaacaggggggttgtgtggtggcgggggctcgccgtcgatctaagtgaggatctcggtgctccgaggaagatgagattcctcaggggatgcgggcgcaggcctgggaggagtgggtgatggggagggaagtggggtctccagagacgcccagagcaggagcaaggccaggctggggactggactggaagagccagggcagccggctctcctcgtgatttatgggcccctcctcatccaccaaactgaaatgagctgccggcccggaccgccgcgggaggtgcccactgcagtggccgccgccgatccagagcctgggcccccgccctcccgcctccccgacagcttgcagccgagccgggccactgtcccccgggagccgcccgtcctcacccccagcccggccggcggcggggccgcttccaatctgccggcgggcacagggggagagcgccgggagccgggcgcggggccaccgccgacctagcccgagggaggagaaagtttttgctcctcccgaccacgccaggctgcccccgggagaattctgcgtttagagggcatgcgggtgccttacgatttgctgcggtctcggtcgctgagcccgacgtaggagccggggtagtttcctgggggctgggggtggtggcaggggcgtgcaggccgggctggaaaggcctggcttcccgagcctgcggggggtaaaaggacgcctctgacccgcccgacctcgatgaaggcgtttgggctccgctctgtccgccctttccgccgcagacccgggttgcgatccctggggctgtgcagagaggatccaggcccgggacacagttcggatctgcccgcggtcctgggccccaacgccgggggctgaccctagaaaggcgctggactggagcccgtgacggggtgggaagggcgagggggcgcatgattcacaatgaaaaggccacgtttccagagttgccttgaaaatgcatccctggacgagctctggctctgcgtggaataagaagccgttagcaggcgtctacactcgcactcggaagctcttgcgtgggtcctgttcagaggtacaacagcaccggccccccaagaggtgcccatgggagaggccataagtggggggtgggcgggttactgccttctttgtcccttgagctgcctcccttgagccacacggatttctcgaggtctccctaacgcccctgacaagatcttcccaagtcctccaacctcgccctgaagtgaagccatcggtctcgtcacttcccaggaagacacctggctttccccactcccgccaggcccacagggtcccaagaggccagagagacaggactgcaaattgtcctacatgggaaacaccgagagcccaacagaaatgccgcaaacaacataacttgaattttcttccccacactagaaaaggggttctcgacgcgcgcgcgcacacacacac

SEQ ID NO: 131259 - DNA, 1651 bp, Homo sapiens
  misc_feature 1..1651: note = chr9:135456996-135458647
  misc_feature 1..1651: note = Hyper
  source 1..1651: mol_type = genomic DNA
tccctttctgctgctggaggaagaaaaacgggggaaggaaaaaggatctacaatagacctgccgacgaataatttgaataactgtgggaaagggtcggggaacgctaaaaaaaaaaaaaaaaagcccagcgcacatcccagcccaccgcagcgcagtcggctcggccccctcccctccagccgtaccccccttggctaatcaccctcattaggagcttcgtcaccggcctaatgaaagcaaaccgtgtggaaatcgccggtaaacagttgggtctgtgctgtaattaattcggtgtctcttttaatcaaactgaaagggaatcgggcagcggcttgcggagccgtgacatcacccccaaaatcggccagagccaatcagcgtcatcactccggggacacgtgggcgagtccccttaaaaaaacacacacaacacaacgaaaaaaaagaaacaacaaaaaaaaacccagacccaaagtaaaagtgacacaagttcattttttaaaggaagggggggaggagaaggcgcgcgcggaccggcagagagctgccgccgaggagcagggaggcgctgtccacggtgctgacgggcccccggagcggcgagggcgcggagagaggacctccccggccaggtggagagtcatgagccgcgggcagccgccgccgctctccgcggtgctgatgccgccaggtgcgctcctttccgcccgctgctagcgcggcccgggcccgcagctatctgcggtgctgacctggccaccctcagccaccacttgcctggaagaagcgtgcggtttggatttttaaaacgccattctttatttagattccaacatcctcgcgtttcttctgtgccaagggggccctcgggccgtccgtctccccctttgctctccccaacttggcgcgccctccctcccattcctccctgacactcccaccaccccccctcggctcggcggctcggcgcgatgctgcagaagacgcactgagcccttttggatctaatgcgcagaggaggttggcccagagctcccgggctcccccaaggctgaactccgtccaaggtgcccgcaggctccctgcccgccttccccatgccagcccgcagctaggggcaggggcagcggcggctggggttgggggtgggtggggagcttttggggaggacaggtcgcagcttggctatggaaggctccaatggctttgggatcgactccattctctcccaccgcgcgggcagccccgcccttcccaagggggaccccttgctcggggactgccgttcgcccctggagctgagtccacgctcagagagcagcagcgactgctcttcgccagcctctccaggaagggactgtttggagacggggaccccacggcctggcggggcatccggcccaggtttggactcccacctgcagcccgggcagctctcagccccggcccagtcgcgcaccgtcacctcctcctttctgatcagggacatccttgccgactgcaaaccactcgcggcctgtgcaccctactctagcagcgggcagccggcagcccctgagcctgggggccgccttgcggccaaggccgcggaggactttagagacaagctggacaaaagtggcagcaacgcctcatcggactctgagtata

SEQ ID NO: 131260 - DNA, 746 bp, Homo sapiens; identical to SEQ ID NO: 100540
  misc_feature 1..746: note = chr9:135459996-135460742
  misc_feature 1..746: note = Hyper
  source 1..746: mol_type = genomic DNA

SEQ ID NO: 131261 - DNA, 30 bp, Homo sapiens; identical to SEQ ID NO: 32776
  misc_feature 1..30: note = chr9:135461292-135461322
  misc_feature 1..30: note = Hyper
  source 1..30: mol_type = genomic DNA

SEQ ID NO: 131262 - DNA, 1625 bp, Homo sapiens
  misc_feature 1..1625: note = chr9:135461541-135463166
  misc_feature 1..1625: note = Hyper
  source 1..1625: mol_type = genomic DNA
tcagttgaaaagtctcgatccctaacggctcaattaaccggattattgtttcctacagagagaaatcaccttgcattcagctgaaccccgtcactgcaaacgccacgcacaatgaaactccaccataaaagaaaacagagaaaaaagggagtaggttgggggaaagccccagtctgagccgccaattttggggaagtggtctagctggttatataatcgctttagagggagaaggagggtgagcattgagcttgttcgattaagtgttttctgtgcagtcaaagccgaacgaaagtgtctgggataaagaaactacctgtgccaggtctatccttcgacctcaggagctgggcccccggtgtaattctgtcccgactgtggggtgtaaacacacgatgccacgcaggtgtagcaggagccatcgttagcgggcaatgtaatgacaacggaacgcagacctgggcaatgcgcgctgcgcccaaggggcaagcgagtggcagggtcgcttattctcccagtgctcggcgctcgcagacccggagccttccgcccagcgccctgtgtaggtagcgagtgtcgggagaaatcatcactacgaattcgtttccatataggggcaacgccaggcggggcacaatgatctgtccttgaggacaaagagtgattccggagagagcaggtttttgtccctccacgcaggtttctctccccagaccccagccttcggcttcctcccttcctgtcacggacgcagccggagaaactggggcccagacgcggagctcactccgccagaaaccctgggtcccttcccctacgctggcaggctgggtccggttccatcgtcgcggctccgtttatccctccagggagcgcgggcagagcgccgagcgcggcgcagggactggagttctcgccagcttcgggttctttctccccggagctgcccggggggtctcggcctcgggcgctcccgccgccgtcctgttcccctcagggttcatgtcctgttcccggggccccagaggtcccgtctgagagcggcccccgcgagcttgggtgtcgcggaaccaccgctgtcggaagccgaggttacacaaacgccacgggcaggagcgggagggcaccggcggcggctgcgaggccgggccctgacatgccgctgtgtccgcagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggtgaggcctggctgcgggggtagaggcagaaagggaacttcccctttcctcacagctcctggaggggaccaggagtctacaggttggtgctaagggagggccccagagcctcccccattctgtaaaagtgggaaactgagtccctaaggggacaaggccttgcccaaagtccccacagcgagggacagagatgagactagacttggtgtccagcgtccagtcagccct

SEQ ID NO: 131263 - DNA, 34 bp, Homo sapiens; identical to SEQ ID NO: 100544
  misc_feature 1..34: note = chr9:135463680-135463714
  misc_feature 1..34: note = Hyper
  source 1..34: mol_type = genomic DNA

SEQ ID NO: 131264 - DNA, 262 bp, Homo sapiens; identical to SEQ ID NO: 100545
  misc_feature 1..262: note = chr9:135463992-135464254
  misc_feature 1..262: note = Hyper
  source 1..262: mol_type = genomic DNA

SEQ ID NO: 131265 - DNA, 275 bp, Homo sapiens; identical to SEQ ID NO: 100546
  misc_feature 1..275: note = chr9:135464664-135464939
  misc_feature 1..275: note = Hyper
  source 1..275: mol_type = genomic DNA

SEQ ID NO: 131266 - DNA, 1502 bp, Homo sapiens
  misc_feature 1..1502: note = chr9:135465191-135466693
  misc_feature 1..1502: note = Hyper
  source 1..1502: mol_type = genomic DNA
acccccagcctctgccggctcccctaggcaacccctttctccccaggagcgggtgcggctgattcccaggcttcgctctctcccacgccccttctacgctccaggtggagaacagcccctctccccgcgcccccgccagggagagaaggggagtgcggagccccgtctccctacccctcgagcacctgggccagcggctgagctgtacataccgtgtgcaaagtgtatatgaagttatttattcgtgacccatgagcccgtgaccgtgtccgtggattagtgagtctgtggcctgtgccctccccactcccaggcggggcaggaaggggccaagggggcttgcccacccaccccgaccccagcccccagcctcagccccggtccgggggcagccaggcctctcgggttctctcttttttaaatgtcgaaataaacttcttacaaatgaccaggcgcctgtccgcgctcgcgtcgctgggtccgcactcaacccctctcccatccctctcctggggactcggtttccttccatcctcaataacgaaacatttttgtcccccttctcttccccggtgctgtggacatgcgcgggggccccgacgggactcgctggggcccgggtctcccctccctggcctcagtcttcccatctctacagcgaggccagctcgttgttcccctcctcctcctctgtctccatctggttcctagcggctcccagacggtcccgagggccggggcgggggtccgtgccggaacaggcgggggtcagcgcggggcctcggtcggctgcgggccgggctgcggggccctcgccgagccgactcatctggccgcgacaagggccccggcagctggtgaccggcccgccgggcgcgggccgacagatgggctccgaggctgctccccccatcactcccaccctccgcccagcgtccggccgcgctcgggctcccgacgctcgcgggcgccaaggcggcccgggcctcccggcctcccgcaccaggcaggactccgcgcgccttcgctgcgaaccagacgccacatcgggtaaacccccactcccacatcttctcacctcccctttaccccgggaggaggttggaaatgagacccagaggggagccaaatcccagcgtctgccccatctcttctggctgccccagaccgcagctctagcatctcaggggagaggggtttaagtcccgagtcagactcgaggcttccagttcacgtccaaagggccacggtcacctgagactgctccctctctggggaggtgggcgcaggtgctcccttcccacacaccacctgcagctcgctaaccctcagcgctgggaagttttgggggccggcaagccgtggcccctctagtttgggggcagggtttctctgaagacgggggctgtgttcagactataacccctctcgaaaaccatacccacagccaggtccgctactgtttcctccctgccccgaaacaccctcgcacagcagctttc

SEQ ID NO: 131267 - DNA, 204 bp, Homo sapiens; identical to SEQ ID NO: 42260
  misc_feature 1..204: note = chr9:135512910-135513114
  misc_feature 1..204: note = Hypo
  source 1..204: mol_type = genomic DNA

SEQ ID NO: 131268 - DNA, 86 bp, Homo sapiens; identical to SEQ ID NO: 100550
  misc_feature 1..86: note = chr9:135548179-135548265
  misc_feature 1..86: note = Hypo
  source 1..86: mol_type = genomic DNA

SEQ ID NO: 131269 - DNA, 85 bp, Homo sapiens; identical to SEQ ID NO: 100551
  misc_feature 1..85: note = chr9:135548565-135548650
  misc_feature 1..85: note = Hypo
  source 1..85: mol_type = genomic DNA

SEQ ID NO: 131270 - DNA, 38 bp, Homo sapiens; identical to SEQ ID NO: 100552
  misc_feature 1..38: note = chr9:135645212-135645250
  misc_feature 1..38: note = Hyper
  source 1..38: mol_type = genomic DNA

SEQ ID NO: 131271 - DNA, 280 bp, Homo sapiens; identical to SEQ ID NO: 32783
  misc_feature 1..280: note = chr9:135645863-135646143
  misc_feature 1..280: note = Hyper
  source 1..280: mol_type = genomic DNA

SEQ ID NO: 131272 - DNA, 74 bp, Homo sapiens; identical to SEQ ID NO: 42262
  misc_feature 1..74: note = chr9:135768018-135768092
  misc_feature 1..74: note = Hypo
  source 1..74: mol_type = genomic DNA

SEQ ID NO: 131273 - DNA, 30 bp, Homo sapiens; identical to SEQ ID NO: 42263
  misc_feature 1..30: note = chr9:135833429-135833459
  misc_feature 1..30: note = Hypo
  source 1..30: mol_type = genomic DNA

SEQ ID NO: 131274 - DNA, 188 bp, Homo sapiens; identical to SEQ ID NO: 100557
  misc_feature 1..188: note = chr9:135865042-135865230
  misc_feature 1..188: note = Hypo
  source 1..188: mol_type = genomic DNA

SEQ ID NO: 131275 - DNA, 246 bp, Homo sapiens; identical to SEQ ID NO: 42265
  misc_feature 1..246: note = chr9:135898878-135899124
  misc_feature 1..246: note = Hypo
  source 1..246: mol_type = genomic DNA

SEQ ID NO: 131276 - DNA, 56 bp, Homo sapiens; identical to SEQ ID NO: 42266
  misc_feature 1..56: note = chr9:135908143-135908199
  misc_feature 1..56: note = Hypo
  source 1..56: mol_type = genomic DNA

SEQ ID NO: 131277 - DNA, 30 bp, Homo sapiens; identical to SEQ ID NO: 100560
  misc_feature 1..30: note = chr9:135909759-135909789
  misc_feature 1..30: note = Hypo
  source 1..30: mol_type = genomic DNA

SEQ ID NO: 131278 - DNA, 107 bp, Homo sapiens; identical to SEQ ID NO: 100561
  misc_feature 1..107: note = chr9:136029028-136029135
  misc_feature 1..107: note = Hypo
  source 1..107: mol_type = genomic DNA

SEQ ID NO: 131279 - DNA, 675 bp, Homo sapiens; identical to SEQ ID NO: 100562
  misc_feature 1..675: note = chr9:136038772-136039447
  misc_feature 1..675: note = Hyper
  source 1..675: mol_type = genomic DNA

SEQ ID NO: 131280 - DNA, 30 bp, Homo sapiens; identical to SEQ ID NO: 100563
  misc_feature 1..30: note = chr9:136151457-136151487
  misc_feature 1..30: note = Hyper
  source 1..30: mol_type = genomic DNA

SEQ ID NO: 131281 - DNA, 160 bp, Homo sapiens; identical to SEQ ID NO: 100564
  misc_feature 1..160: note = chr9:136375573-136375733
  misc_feature 1..160: note = Hypo
  source 1..160: mol_type = genomic DNA

SEQ ID NO: 131282 - DNA, 90 bp, Homo sapiens; identical to SEQ ID NO: 100565
  misc_feature 1..90: note = chr9:136378429-136378519
  misc_feature 1..90: note = Hypo
  source 1..90: mol_type = genomic DNA

SEQ ID NO: 131283 - DNA, 86 bp, Homo sapiens; identical to SEQ ID NO: 100566
  misc_feature 1..86: note = chr9:136383935-136384021
  misc_feature 1..86: note = Hypo
  source 1..86: mol_type = genomic DNA

SEQ ID NO: 131284 - DNA, 30 bp, Homo sapiens; identical to SEQ ID NO: 100567
  misc_feature 1..30: note = chr9:136395929-136395959
  misc_feature 1..30: note = Hypo
  source 1..30: mol_type = genomic DNA

SEQ ID NO: 131285 - DNA, 127 bp, Homo sapiens; identical to SEQ ID NO: 100568
  misc_feature 1..127: note = chr9:136399516-136399643
  misc_feature 1..127: note = Hyper
  source 1..127: mol_type = genomic DNA

SEQ ID NO: 131286 - DNA, 94 bp, Homo sapiens; identical to SEQ ID NO: 100569
  misc_feature 1..94: note = chr9:136400112-136400206
  misc_feature 1..94: note = Hyper
  source 1..94: mol_type = genomic DNA

SEQ ID NO: 131287 - DNA, 555 bp, Homo sapiens
  misc_feature 1..555: note = chr9:136474227-136474782
  misc_feature 1..555: note = Hyper
  source 1..555: mol_type = genomic DNA
ccgcgaggacttgggcgcacgtgacggggcgggcgggcgtccgacccgggcagggcgcagctagcggcggccgctcatgcccaggccacggcggtggcgcctggtgtggctgggcgggcgaggcgggcgctgagaagcccgggaggcccccggggaggcgactgcgtgcccaggcgggcacccctgccagctccgcgctgcggccgcgactccggacgccccggctggctccctgcgagctgcacgcgcggctccagcctggtcccgagcgcagggcgcgcgctggcggggagggcgcgcgcccgagcctggcggggagcgcgcgtcaccggcccgcgcgcgcagtcgtcgggggatgccgggagcggcctggggagctgtccctggtgctgacggctcgtccgctctcgcccgggacgcgcgacctcctggaggcctgggggtgcccccaccctggccggcgccctgcggtgctccctccgctctccgcctgttctcggggcgttccggcttccacaacgttgggatctggagtcaggccgaagctgctgctta

SEQ ID NO: 131288 - DNA, 30 bp, Homo sapiens; identical to SEQ ID NO: 100573
  misc_feature 1..30: note = chr9:136477280-136477310
  misc_feature 1..30: note = Hypo
  source 1..30: mol_type = genomic DNA

SEQ ID NO: 131289 - DNA, 59 bp, Homo sapiens; identical to SEQ ID NO: 100574
  misc_feature 1..59: note = chr9:136521608-136521667
  misc_feature 1..59: note = Hypo
  source 1..59: mol_type = genomic DNA

SEQ ID NO: 131290 - DNA, 42 bp, Homo sapiens; identical to SEQ ID NO: 100575
  misc_feature 1..42: note = chr9:136527279-136527321
  misc_feature 1..42: note = Hypo
  source 1..42: mol_type = genomic DNA

SEQ ID NO: 131291 - DNA, 123 bp, Homo sapiens; identical to SEQ ID NO: 100576
  misc_feature 1..123: note = chr9:136553113-136553236
  misc_feature 1..123: note = Hypo
  source 1..123: mol_type = genomic DNA

SEQ ID NO: 131292 - DNA, 30 bp, Homo sapiens; identical to SEQ ID NO: 42270
  misc_feature 1..30: note = chr9:136559282-136559312
  misc_feature 1..30: note = Hypo
  source 1..30: mol_type = genomic DNA

SEQ ID NO: 131293 - DNA, 188 bp, Homo sapiens; identical to SEQ ID NO: 100578
  misc_feature 1..188: note = chr9:136573297-136573485
  misc_feature 1..188: note = Hypo
  source 1..188: mol_type = genomic DNA

SEQ ID NO: 131294 - DNA, 110 bp, Homo sapiens; identical to SEQ ID NO: 100579
  misc_feature 1..110: note = chr9:136603522-136603632
  misc_feature 1..110: note = Hyper
  source 1..110: mol_type = genomic DNA

SEQ ID NO: 131295 - DNA, 112 bp, Homo sapiens; identical to SEQ ID NO: 100580
  misc_feature 1..112: note = chr9:136658252-136658364
  misc_feature 1..112: note = Hyper
  source 1..112: mol_type = genomic DNA

SEQ ID NO: 131296 - DNA, 39 bp, Homo sapiens; identical to SEQ ID NO: 100581
  misc_feature 1..39: note = chr9:136708022-136708061
  misc_feature 1..39: note = Hypo
  source 1..39: mol_type = genomic DNA

SEQ ID NO: 131297 - DNA, 30 bp, Homo sapiens; identical to SEQ ID NO: 100582
  misc_feature 1..30: note = chr9:136727495-136727525
  misc_feature 1..30: note = Hypo
  source 1..30: mol_type = genomic DNA

SEQ ID NO: 131298 - DNA, 97 bp, Homo sapiens; identical to SEQ ID NO: 100583
  misc_feature 1..97: note = chr9:136728397-136728494
  misc_feature 1..97: note = Hypo
  source 1..97: mol_type = genomic DNA

SEQ ID NO: 131299 - DNA, 53 bp, Homo sapiens; identical to SEQ ID NO: 100584
  misc_feature 1..53: note = chr9:136837620-136837673
  misc_feature 1..53: note = Hypo
  source 1..53: mol_type = genomic DNA

SEQ ID NO: 131300 - DNA, 42 bp, Homo sapiens; identical to SEQ ID NO: 100585
  misc_feature 1..42: note = chr9:136860951-136860993
  misc_feature 1..42: note = Hypo
  source 1..42: mol_type = genomic DNA

SEQ ID NO: 131301 - DNA, 178 bp, Homo sapiens; identical to SEQ ID NO: 100586
  misc_feature 1..178: note = chr9:136931060-136931238
  misc_feature 1..178: note = Hyper
  source 1..178: mol_type = genomic DNA

SEQ ID NO: 131302 - DNA, 145 bp, Homo sapiens; identical to SEQ ID NO: 100587
  misc_feature 1..145: note = chr9:136990501-136990646
  misc_feature 1..145: note = Hypo
  source 1..145: mol_type = genomic DNA

SEQ ID NO: 131303 - DNA, 30 bp, Homo sapiens; identical to SEQ ID NO: 15265
  misc_feature 1..30: note = chr9:136999528-136999558
  misc_feature 1..30: note = Hypo
  source 1..30: mol_type = genomic DNA

SEQ ID NO: 131304 - DNA, 32 bp, Homo sapiens; identical to SEQ ID NO: 100589
  misc_feature 1..32: note = chr9:137024169-137024201
  misc_feature 1..32: note = Hypo
  source 1..32: mol_type = genomic DNA

SEQ ID NO: 131305 - DNA, 151 bp, Homo sapiens; identical to SEQ ID NO: 100590
  misc_feature 1..151: note = chr9:137248217-137248368
  misc_feature 1..151: note = Hypo
  source 1..151: mol_type = genomic DNA

SEQ ID NO: 131306 - DNA, 126 bp, Homo sapiens; identical to SEQ ID NO: 100591
  misc_feature 1..126: note = chr9:137281012-137281138
  misc_feature 1..126: note = Hypo
  source 1..126: mol_type = genomic DNA

SEQ ID NO: 131307 - DNA, 39 bp, Homo sapiens; identical to SEQ ID NO: 32791
  misc_feature 1..39: note = chr9:137295661-137295700
  misc_feature 1..39: note = Hyper
  source 1..39: mol_type = genomic DNA

SEQ ID NO: 131308 - DNA, 456 bp, Homo sapiens; identical to SEQ ID NO: 100593
  misc_feature 1..456: note = chr9:137299119-137299575
  misc_feature 1..456: note = Hyper
  source 1..456: mol_type = genomic DNA

SEQ ID NO: 131309 - DNA, 30 bp, Homo sapiens; identical to SEQ ID NO: 100594
  misc_feature 1..30: note = chr9:137306458-137306488
  misc_feature 1..30: note = Hypo
  source 1..30: mol_type = genomic DNA

SEQ ID NO: 131310 - DNA, 30 bp, Homo sapiens; identical to SEQ ID NO: 100595
  misc_feature 1..30: note = chr9:137312093-137312123
  misc_feature 1..30: note = Hypo
  source 1..30: mol_type = genomic DNA

SEQ ID NO: 131311 - DNA, 42 bp, Homo sapiens; identical to SEQ ID NO: 100596
  misc_feature 1..42: note = chr9:137312331-137312373
  misc_feature 1..42: note = Hypo
  source 1..42: mol_type = genomic DNA

SEQ ID NO: 131312 - DNA, 33 bp, Homo sapiens; identical to SEQ ID NO: 100597
  misc_feature 1..33: note = chr9:137312923-137312956
  misc_feature 1..33: note = Hypo
  source 1..33: mol_type = genomic DNA

SEQ ID NO: 131313 - DNA, 30 bp, Homo sapiens; identical to SEQ ID NO: 100598
  misc_feature 1..30: note = chr9:137328381-137328411
  misc_feature 1..30: note = Hypo
  source 1..30: mol_type = genomic DNA

SEQ ID NO: 131314 - DNA, 48 bp, Homo sapiens; identical to SEQ ID NO: 100599
  misc_feature 1..48: note = chr9:137386151-137386199
  misc_feature 1..48: note = Hypo
  source 1..48: mol_type = genomic DNA

SEQ ID NO: 131315 - DNA, 46 bp, Homo sapiens; identical to SEQ ID NO: 100600
  misc_feature 1..46: note = chr9:137427038-137427084
  misc_feature 1..46: note = Hypo
  source 1..46: mol_type = genomic DNA

SEQ ID NO: 131316 - DNA, 30 bp, Homo sapiens; identical to SEQ ID NO: 100601
  misc_feature 1..30: note = chr9:137439116-137439146
  misc_feature 1..30: note = Hypo
  source 1..30: mol_type = genomic DNA

SEQ ID NO: 131317 - DNA, 195 bp, Homo sapiens; identical to SEQ ID NO: 100602
  misc_feature 1..195: note = chr9:137457365-137457560
  misc_feature 1..195: note = Hypo
  source 1..195: mol_type = genomic DNA

SEQ ID NO: 131318 - DNA, 87 bp, Homo sapiens; identical to SEQ ID NO: 100603
  misc_feature 1..87: note = chr9:137489165-137489252
  misc_feature 1..87: note = Hypo
  source 1..87: mol_type = genomic DNA

SEQ ID NO: 131319 - DNA, 195 bp, Homo sapiens; identical to SEQ ID NO: 100604
  misc_feature 1..195: note = chr9:137519751-137519946
  misc_feature 1..195: note = Hypo
  source 1..195: mol_type = genomic DNA

SEQ ID NO: 131320 - DNA, 30 bp, Homo sapiens; identical to SEQ ID NO: 32793
  misc_feature 1..30: note = chr9:137533003-137533033
  misc_feature 1..30: note = Hyper
  source 1..30: mol_type = genomic DNA

SEQ ID NO: 131321 - DNA, 1062 bp, Homo sapiens
  misc_feature 1..1062: note = chr9:137533496-137534558
  misc_feature 1..1062: note = Hyper
  source 1..1062: mol_type = genomic DNA
gcgcccagtgggaggcgggggctggcctcgccgagcccagcgccgggctctgatttgctgcgggcgttggggatcgacagcctccgcggctgccttccaggagagagggagggaggaaaagggggaaaaaagtgctccgcgccgaaggcgaggtccgcactctccgtccccgcggctggcgcaggacctcactcgagcggagcgcccacggggagcgggtcgcggggcggcggcggcgaggaggaggcgagaaggagttggaggaggaggaggaggaggcgagggcgagctagcccagcggggtcccggccgccccgcgggccaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcaggtaagggcgccccggggcgcggggctgcgggatggggcgcgcgcagcccgggcgccgctgtcatccccgggcgccttcgcccgcagaacttttcttccttggcctgtggaatgcacgggccaagaccacgaatgccatttgctgggggcccccccgagatgacgacacgcagacacaatgcccgcgggcgcgccgccgccccctccccagacgggcgggtcgggtggggctgtcgcgcgagccgaggaaggaccgagggctggatcagcaggaggggttgtccacgaggcgggcaaacttttgtcccaaaaaccttccttctctgtcccacatcacaggcgcccagcttgggccctcacagccctacagcagaacttcctctgctccaaaccgggcagggccgccccctagagtta

SEQ ID NO: 131322 - DNA, 90 bp, Homo sapiens; identical to SEQ ID NO: 100608
  misc_feature 1..90: note = chr9:137539456-137539546
  misc_feature 1..90: note = Hypo
  source 1..90: mol_type = genomic DNA

SEQ ID NO: 131323 - DNA, 180 bp, Homo sapiens; identical to SEQ ID NO: 100609
  misc_feature 1..180: note = chr9:137580727-137580907
  misc_feature 1..180: note = Hypo
  source 1..180: mol_type = genomic DNA

SEQ ID NO: 131324 - DNA, 30 bp, Homo sapiens; identical to SEQ ID NO: 100610
  misc_feature 1..30: note = chr9:137601900-137601930
  misc_feature 1..30: note = Hypo
  source 1..30: mol_type = genomic DNA

SEQ ID NO: 131325 - DNA, 35 bp, Homo sapiens; identical to SEQ ID NO: 42278
  misc_feature 1..35: note = chr9:137602268-137602303
  misc_feature 1..35: note = Hypo
  source 1..35: mol_type = genomic DNA

SEQ ID NO: 131326 - DNA, 34 bp, Homo sapiens; identical to SEQ ID NO: 100612
  misc_feature 1..34: note = chr9:137602975-137603009
  misc_feature 1..34: note = Hypo
  source 1..34: mol_type = genomic DNA

SEQ ID NO: 131327 - DNA, 48 bp, Homo sapiens; identical to SEQ ID NO: 100613
  misc_feature 1..48: note = chr9:137609353-137609401
  misc_feature 1..48: note = Hypo
  source 1..48: mol_type = genomic DNA

SEQ ID NO: 131328 - DNA, 36 bp, Homo sapiens; identical to SEQ ID NO: 100614
  misc_feature 1..36: note = chr9:137616322-137616358
  misc_feature 1..36: note = Hypo
  source 1..36: mol_type = genomic DNA

SEQ ID NO: 131329 - DNA, 33 bp, Homo sapiens; identical to SEQ ID NO: 100615
  misc_feature 1..33: note = chr9:137616641-137616674
  misc_feature 1..33: note = Hypo
  source 1..33: mol_type = genomic DNA

SEQ ID NO: 131330 - DNA, 192 bp, Homo sapiens; identical to SEQ ID NO: 100616
  misc_feature 1..192: note = chr9:137623351-137623543
  misc_feature 1..192: note = Hypo
  source 1..192: mol_type = genomic DNA

SEQ ID NO: 131331 - DNA, 184 bp, Homo sapiens; identical to SEQ ID NO: 100617
  misc_feature 1..184: note = chr9:137624178-137624362
  misc_feature 1..184: note = Hypo
  source 1..184: mol_type = genomic DNA

SEQ ID NO: 131332 - DNA, 30 bp, Homo sapiens; identical to SEQ ID NO: 42280
  misc_feature 1..30: note = chr9:137631987-137632017
  misc_feature 1..30: note = Hypo
  source 1..30: mol_type = genomic DNA

SEQ ID NO: 131333 - DNA, 51 bp, Homo sapiens; identical to SEQ ID NO: 100619
  misc_feature 1..51: note = chr9:137638944-137638995
  misc_feature 1..51: note = Hypo
  source 1..51: mol_type = genomic DNA

SEQ ID NO: 131334 - DNA, 30 bp, Homo sapiens; identical to SEQ ID NO: 100620
  misc_feature 1..30: note = chr9:137650802-137650832
  misc_feature 1..30: note = Hypo
  source 1..30: mol_type = genomic DNA

SEQ ID NO: 131335 - DNA, 30 bp, Homo sapiens; identical to SEQ ID NO: 100621
  misc_feature 1..30: note = chr9:137652857-137652887
  misc_feature 1..30: note = Hypo
  source 1..30: mol_type = genomic DNA

SEQ ID NO: 131336 - DNA, 233 bp, Homo sapiens; identical to SEQ ID NO: 100622
  misc_feature 1..233: note = chr9:137656918-137657151
  misc_feature 1..233: note = Hypo
  source 1..233: mol_type = genomic DNA

SEQ ID NO: 131337 - DNA, 125 bp, Homo sapiens; identical to SEQ ID NO: 100623
  misc_feature 1..125: note = chr9:137667232-137667357
  misc_feature 1..125: note = Hypo
  source 1..125: mol_type = genomic DNA

SEQ ID NO: 131338 - DNA, 30 bp, Homo sapiens; identical to SEQ ID NO: 100624
  misc_feature 1..30: note = chr9:137674975-137675005
  misc_feature 1..30: note = Hypo
  source 1..30: mol_type = genomic DNA

SEQ ID NO: 131339 - DNA, 35 bp, Homo sapiens; identical to SEQ ID NO: 42284
  misc_feature 1..35: note = chr9:137685677-137685712
  misc_feature 1..35: note = Hypo
  source 1..35: mol_type = genomic DNA

SEQ ID NO: 131340 - DNA, 165 bp, Homo sapiens; identical to SEQ ID NO: 100626
  misc_feature 1..165: note = chr9:137687742-137687907
  misc_feature 1..165: note = Hypo
  source 1..165: mol_type = genomic DNA

SEQ ID NO: 131341 - DNA, 381 bp, Homo sapiens; identical to SEQ ID NO: 100627
  misc_feature 1..381: note = chr9:137694270-137694651
  misc_feature 1..381: note = Hypo
  source 1..381: mol_type = genomic DNA

SEQ ID NO: 131342 - DNA, 30 bp, Homo sapiens; identical to SEQ ID NO: 100628
  misc_feature 1..30: note = chr9:137696349-137696379
  misc_feature 1..30: note = Hypo
  source 1..30: mol_type = genomic DNA

SEQ ID NO: 131343 - DNA, 30 bp, Homo sapiens; identical to SEQ ID NO: 100629
  misc_feature 1..30: note = chr9:137698436-137698466
  misc_feature 1..30: note = Hypo
  source 1..30: mol_type = genomic DNA

SEQ ID NO: 131344 - DNA, 30 bp, Homo sapiens; identical to SEQ ID NO: 100630
  misc_feature 1..30: note = chr9:137701048-137701078
  misc_feature 1..30: note = Hypo
  source 1..30: mol_type = genomic DNA

SEQ ID NO: 131345 - DNA, 30 bp, Homo sapiens; identical to SEQ ID NO: 100631
  misc_feature 1..30: note = chr9:137703099-137703129
  misc_feature 1..30: note = Hypo
  source 1..30: mol_type = genomic DNA

SEQ ID NO: 131346 - DNA, 397 bp, Homo sapiens; identical to SEQ ID NO: 100632
  misc_feature 1..397: note = chr9:137710195-137710592
  misc_feature 1..397: note = Hypo
  source 1..397: mol_type = genomic DNA

SEQ ID NO: 131347 - DNA, 40 bp, Homo sapiens; identical to SEQ ID NO: 100633
  misc_feature 1..40: note = chr9:137711094-137711134
  misc_feature 1..40: note = Hypo
  source 1..40: mol_type = genomic DNA

SEQ ID NO: 131348 - DNA, 198 bp, Homo sapiens; identical to SEQ ID NO: 100634
  misc_feature 1..198: note = chr9:137716801-137716999
  misc_feature 1..198: note = Hypo
  source 1..198: mol_type = genomic DNA

SEQ ID NO: 131349 - DNA, 264 bp, Homo sapiens; identical to SEQ ID NO: 100635
  misc_feature 1..264: note = chr9:137718850-137719114
  misc_feature 1..264: note = Hypo
  source 1..264: mol_type = genomic DNA

SEQ ID NO: 131350 - DNA, 300 bp, Homo sapiens; identical to SEQ ID NO: 100636
  misc_feature 1..300: note = chr9:137719318-137719618
  misc_feature 1..300: note = Hypo
  source 1..300: mol_type = genomic DNA

SEQ ID NO: 131351 - DNA, 30 bp, Homo sapiens; identical to SEQ ID NO: 100637
  misc_feature 1..30: note = chr9:137720183-137720213
  misc_feature 1..30: note = Hypo
  source 1..30: mol_type = genomic DNA

SEQ ID NO: 131352 - DNA, 63 bp, Homo sapiens; identical to SEQ ID NO: 100638
  misc_feature 1..63: note = chr9:137721214-137721277
  misc_feature 1..63: note = Hypo
  source 1..63: mol_type = genomic DNA

SEQ ID NO: 131353 - DNA, 161 bp, Homo sapiens; identical to SEQ ID NO: 100639
  misc_feature 1..161: note = chr9:137721661-137721822
  misc_feature 1..161: note = Hypo
  source 1..161: mol_type = genomic DNA

SEQ ID NO: 131354 - DNA, 41 bp, Homo sapiens; identical to SEQ ID NO: 100640
  misc_feature 1..41: note = chr9:137722056-137722097
  misc_feature 1..41: note = Hypo
  source 1..41: mol_type = genomic DNA

SEQ ID NO: 131355 - DNA, 156 bp, Homo sapiens; identical to SEQ ID NO: 100641
  misc_feature 1..156: note = chr9:137724524-137724680
  misc_feature 1..156: note = Hypo
  source 1..156: mol_type = genomic DNA

SEQ ID NO: 131356 - DNA, 69 bp, Homo sapiens; identical to SEQ ID NO: 100642
  misc_feature 1..69: note = chr9:137726887-137726956
  misc_feature 1..69: note = Hypo
  source 1..69: mol_type = genomic DNA

SEQ ID NO: 131357 - DNA, 45 bp, Homo sapiens; identical to SEQ ID NO: 100643
  misc_feature 1..45: note = chr9:137730826-137730871
  misc_feature 1..45: note = Hypo
  source 1..45: mol_type = genomic DNA

SEQ ID NO: 131358 - DNA, 33 bp, Homo sapiens; identical to SEQ ID NO: 100644
  misc_feature 1..33: note = chr9:137731553-137731586
  misc_feature 1..33: note = Hypo
  source 1..33: mol_type = genomic DNA

SEQ ID NO: 131359 - DNA, 30 bp, Homo sapiens; identical to SEQ ID NO: 100645
  misc_feature 1..30: note = chr9:137731848-137731878
  misc_feature 1..30: note = Hypo
  source 1..30: mol_type = genomic DNA

SEQ ID NO: 131360 - DNA, 60 bp, Homo sapiens; identical to SEQ ID NO: 42294
  misc_feature 1..60: note = chr9:137734084-137734144
  misc_feature 1..60: note = Hypo
  source 1..60: mol_type = genomic DNA

SEQ ID NO: 131361 - DNA, 30 bp, Homo sapiens; identical to SEQ ID NO: 100647
  misc_feature 1..30: note = chr9:137747704-137747734
  misc_feature 1..30: note = Hypo
  source 1..30: mol_type = genomic DNA

SEQ ID NO: 131362 - DNA, 30 bp, Homo sapiens; identical to SEQ ID NO: 100648
  misc_feature 1..30: note = chr9:137771562-137771592
  misc_feature 1..30: note = Hypo
  source 1..30: mol_type = genomic DNA

SEQ ID NO: 131363 - DNA, 30 bp, Homo sapiens; identical to SEQ ID NO: 100649
  misc_feature 1..30: note = chr9:137771832-137771862
  misc_feature 1..30: note = Hypo
  source 1..30: mol_type = genomic DNA

SEQ ID NO: 131364 - DNA, 30 bp, Homo sapiens; identical to SEQ ID NO: 100650
  misc_feature 1..30: note = chr9:137774917-137774947
  misc_feature 1..30: note = Hypo
  source 1..30: mol_type = genomic DNA

SEQ ID NO: 131365 - DNA, 30 bp, Homo sapiens; identical to SEQ ID NO: 100651
  misc_feature 1..30: note = chr9:137777607-137777637
  misc_feature 1..30: note = Hypo
  source 1..30: mol_type = genomic DNA

SEQ ID NO: 131366 - DNA, 30 bp, Homo sapiens; identical to SEQ ID NO: 100652
  misc_feature 1..30: note = chr9:137804943-137804973
  misc_feature 1..30: note = Hypo
  source 1..30: mol_type = genomic DNA

SEQ ID NO: 131367 - DNA, 33 bp, Homo sapiens; identical to SEQ ID NO: 100653
  misc_feature 1..33: note = chr9:137805825-137805858
  misc_feature 1..33: note = Hypo
  source 1..33: mol_type = genomic DNA

SEQ ID NO: 131368 - DNA, 30 bp, Homo sapiens; identical to SEQ ID NO: 100654
  misc_feature 1..30: note = chr9:137832202-137832232
  misc_feature 1..30: note = Hypo
  source 1..30: mol_type = genomic DNA

SEQ ID NO: 131369 - DNA, 30 bp, Homo sapiens; identical to SEQ ID NO: 100655
  misc_feature 1..30: note = chr9:137840749-137840779
  misc_feature 1..30: note = Hypo
  source 1..30: mol_type = genomic DNA

SEQ ID NO: 131370 - DNA, 30 bp, Homo sapiens; identical to SEQ ID NO: 42295
  misc_feature 1..30: note = chr9:137851369-137851399
  misc_feature 1..30: note = Hypo
  source 1..30: mol_type = genomic DNA

SEQ ID NO: 131371 - DNA, 576 bp, Homo sapiens; identical to SEQ ID NO: 100657
  misc_feature 1..576: note = chr9:137854764-137855340
  misc_feature 1..576: note = Hypo
  source 1..576: mol_type = genomic DNA

SEQ ID NO: 131372 - DNA, 163 bp, Homo sapiens; identical to SEQ ID NO: 100658
  misc_feature 1..163: note = chr9:137865081-137865244
  misc_feature 1..163: note = Hypo
  source 1..163: mol_type = genomic DNA

SEQ ID NO: 131373 - DNA, 30 bp, Homo sapiens; identical to SEQ ID NO: 100659
  misc_feature 1..30: note = chr9:137901149-137901179
  misc_feature 1..30: note = Hypo
  source 1..30: mol_type = genomic DNA

SEQ ID NO: 131374 - DNA, 30 bp, Homo sapiens; identical to SEQ ID NO: 100660
  misc_feature 1..30: note = chr9:137937191-137937221
  misc_feature 1..30: note = Hypo
  source 1..30: mol_type = genomic DNA

SEQ ID NO: 131375 - DNA, 30 bp, Homo sapiens; identical to SEQ ID NO: 100661
  misc_feature 1..30: note = chr9:137937533-137937563
  misc_feature 1..30: note = Hypo
  source 1..30: mol_type = genomic DNA

SEQ ID NO: 131376 - DNA, 737 bp, Homo sapiens
  misc_feature 1..737: note = chr9:137967194-137967931
  misc_feature 1..737: note = Hyper
  source 1..737: mol_type = genomic DNA
acttttggcacccaccgcagcccagcgcgcgttcgtgctccgcagggcgcgcctctctccgccaatgccaggcgcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagtacgtgcatccaacgccattttcctccctgccaggcgcccggcccggcccctcgggagccccacaaagtccgggaacggctctggctccgcgccgccccgcgcccccggcctgggcgcccgaagtgccggggttggggagggggccagggcgctaggctggacctgggtgggagggaggggtgcaggctgaccggagacggcgctcctccagccccggctcagcagagctgacagctgccccctttttcctaggactccgctgcccccgactccctgctgag

SEQ ID NO: 131377 - DNA, 30 bp, Homo sapiens; identical to SEQ ID NO: 100665
  misc_feature 1..30: note = chr9:137977952-137977982
  misc_feature 1..30: note = Hyper
  source 1..30: mol_type = genomic DNA

SEQ ID NO: 131378 - DNA, 126 bp, Homo sapiens; identical to SEQ ID NO: 100666
  misc_feature 1..126: note = chr9:137978937-137979063
  misc_feature 1..126: note = Hyper
  source 1..126: mol_type = genomic DNA

SEQ ID NO: 131379 - DNA, 1533 bp, Homo sapiens
  misc_feature 1..1533: note = chr9:137979475-137981008
  misc_feature 1..1533: note = Hyper
  source 1..1533: mol_type = genomic DNA
cccggccgcggcccccgcgcgcagcccgcgcagcgctcagagccggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccggggcgcgcggggcggcggcggcggcgggcgggcggcggcgggccgagggggcgcggggacacagccaggcgcccctgcccgccgcggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtaagtgcgcccgccggccgccttggcgcggctcctcctcctcctcctcctccccctcctcggtccggagccccgggctgggcgggcgccgcgcgggacccgagtcgcccagggaggcggcggggagcagggcgggcaagggcaggcgtcgcgggccggcgcagcggtggcgaccctgctccccgctcccccagcctgggccactccatctccgcccgcgcgcccctggggcggcgtttccttcgtctgggcccctcgccgcggggccgggggagcttggtgggttctcggaggcttggagtcctgggtcagtaatcatgagccccccattgaaaaggttaggaaactaaggctggggacttggggacttgtccaaggtcacactcagcgagtgaggggtggagccgccgctagaccctagtctgggctcggtccagcggggactgagcccgccctagtttgtaaaagccagactggccggaccgggctgggagtggggccccagccggtgggctccggagctcctgcccgcgcctgcattcccaaagtcccaaggcgccctttcctccccagtccataggagggtttgttccttctcctccgaggacggtgccgaggggcttgggtggggcccctgggagcctgcccttgggcgctcaccccctcgcctttgccttcgtcttctgcgcgcacccctccctcctggcctctgaaattgaaatcgcgtctccctctcgagcctagcgggaggggaaccgtggccggggctgcttctgggcagagctgacttagatggctgagcgaggctgagctgaaaccgccacccggagggccgcgcggggaaggggccgctgccgggaaggcgcgccccagaccactggccctttaggctgaaaggagaggtgaaggacgtgagtctccctccctctctctttttgctgccaggggtttagtgccctgcgaagagggctccgtggtgtggctccctcctaagacccctcttgaggccgccctccctgctcc

SEQ ID NO: 131380 - DNA, 30 bp, Homo sapiens; identical to SEQ ID NO: 100669
  misc_feature 1..30: note = chr9:138054641-138054671
  misc_feature 1..30: note = Hypo
  source 1..30: mol_type = genomic DNA

SEQ ID NO: 131381 - DNA, 30 bp, Homo sapiens; identical to SEQ ID NO: 100670
  misc_feature 1..30: note = chr9:138080405-138080435
  misc_feature 1..30: note = Hypo
  source 1..30: mol_type = genomic DNA

SEQ ID NO: 131382 - DNA, 30 bp, Homo sapiens; identical to SEQ ID NO: 100671
  misc_feature 1..30: note = chr9:138131370-138131400
  misc_feature 1..30: note = Hypo
  source 1..30: mol_type = genomic DNA

SEQ ID NO: 131383 - DNA, 30 bp, Homo sapiens; identical to SEQ ID NO: 100672
  misc_feature 1..30: note = chr9:138133678-138133708
  misc_feature 1..30: note = Hypo
  source 1..30: mol_type = genomic DNA

SEQ ID NO: 131384 - DNA, 173 bp, Homo sapiens; identical to SEQ ID NO: 100673
  misc_feature 1..173: note = chr9:138218634-138218807
  misc_feature 1..173: note = Hypo
  source 1..173: mol_type = genomic DNA

SEQ ID NO: 131385 - DNA, 155 bp, Homo sapiens; identical to SEQ ID NO: 100674
  misc_feature 1..155: note = chr9:138265117-138265272
  misc_feature 1..155: note = Hypo
  source 1..155: mol_type = genomic DNA

SEQ ID NO: 131386 - DNA, 142 bp, Homo sapiens; identical to SEQ ID NO: 100675
  misc_feature 1..142: note = chr9:138270882-138271024
  misc_feature 1..142: note = Hypo
  source 1..142: mol_type = genomic DNA

SEQ ID NO: 131387 - DNA, 30 bp, Homo sapiens; identical to SEQ ID NO: 100676
  misc_feature 1..30: note = chr9:138275014-138275044
  misc_feature 1..30: note = Hypo
  source 1..30: mol_type = genomic DNA

SEQ ID NO: 131388 - DNA, 64 bp, Homo sapiens; identical to SEQ ID NO: 100677
  misc_feature 1..64: note = chr9:138288949-138289013
  misc_feature 1..64: note = Hypo
  source 1..64: mol_type = genomic DNA

SEQ ID NO: 131389 - DNA, 438 bp, Homo sapiens; identical to SEQ ID NO: 100678
  misc_feature 1..438: note = chr9:138289352-138289790
  misc_feature 1..438: note = Hypo
  source 1..438: mol_type = genomic DNA

SEQ ID NO: 131390 - DNA, 30 bp, Homo sapiens; identical to SEQ ID NO: 42299
  misc_feature 1..30: note = chr9:138290031-138290061
  misc_feature 1..30: note = Hypo
  source 1..30: mol_type = genomic DNA

SEQ ID NO: 131391 - DNA, 30 bp, Homo sapiens; identical to SEQ ID NO: 100680
  misc_feature 1..30: note = chr9:138339327-138339357
  misc_feature 1..30: note = Hypo
  source 1..30: mol_type = genomic DNA

SEQ ID NO: 131392 - DNA, 30 bp, Homo sapiens; identical to SEQ ID NO: 100681
  misc_feature 1..30: note = chr9:138354047-138354077
  misc_feature 1..30: note = Hypo
  source 1..30: mol_type = genomic DNA

SEQ ID NO: 131393 - DNA, 30 bp, Homo sapiens; identical to SEQ ID NO: 100682
  misc_feature 1..30: note = chr9:138388283-138388313
  misc_feature 1..30: note = Hypo
  source 1..30: mol_type = genomic DNA

SEQ ID NO: 131394 - DNA, 242 bp, Homo sapiens; identical to SEQ ID NO: 100683
  misc_feature 1..242: note = chr9:138393554-138393796
  misc_feature 1..242: note = Hypo
  source 1..242: mol_type = genomic DNA

SEQ ID NO: 131395 - DNA, 146 bp, Homo sapiens; identical to SEQ ID NO: 100684
  misc_feature 1..146: note = chr9:138416374-138416520
  misc_feature 1..146: note = Hypo
  source 1..146: mol_type = genomic DNA

SEQ ID NO: 131396 - DNA, 48 bp, Homo sapiens; identical to SEQ ID NO: 100685
  misc_feature 1..48: note = chr9:138444796-138444844
  misc_feature 1..48: note = Hypo
  source 1..48: mol_type = genomic DNA

SEQ ID NO: 131397 - DNA, 237 bp, Homo sapiens; identical to SEQ ID NO: 100686
  misc_feature 1..237: note = chr9:138506017-138506254
  misc_feature 1..237: note = Hypo
  source 1..237: mol_type = genomic DNA

SEQ ID NO: 131398 - DNA, 30 bp, Homo sapiens; identical to SEQ ID NO: 100687
  misc_feature 1..30: note = chr9:138508740-138508770
  misc_feature 1..30: note = Hypo
  source 1..30: mol_type = genomic DNA

SEQ ID NO: 131399 - DNA, 176 bp, Homo sapiens; identical to SEQ ID NO: 100688
  misc_feature 1..176: note = chr9:138557647-138557823
  misc_feature 1..176: note = Hypo
  source 1..176: mol_type = genomic DNA

SEQ ID NO: 131400 - DNA, 586 bp, Homo sapiens; identical to SEQ ID NO: 100689
  misc_feature 1..586: note = chr9:138562694-138563280
  misc_feature 1..586: note = Hypo
  source 1..586: mol_type = genomic DNA

SEQ ID NO: 131401 - DNA, 78 bp, Homo sapiens; identical to SEQ ID NO: 100690
  misc_feature 1..78: note = chr9:138577356-138577434
  misc_feature 1..78: note = Hypo
  source 1..78: mol_type = genomic DNA

SEQ ID NO: 131402 - DNA, 235 bp, Homo sapiens; identical to SEQ ID NO: 100691
  misc_feature 1..235: note = chr9:138577643-138577878
  misc_feature 1..235: note = Hypo
  source 1..235: mol_type = genomic DNA

SEQ ID NO: 131403 - DNA, 30 bp, Homo sapiens; identical to SEQ ID NO: 42308
  misc_feature 1..30: note = chr9:138587151-138587181
  misc_feature 1..30: note = Hypo
  source 1..30: mol_type = genomic DNA

SEQ ID NO: 131404 - DNA, 30 bp, Homo sapiens; identical to SEQ ID NO: 100693
  misc_feature 1..30: note = chr9:138590884-138590914
  misc_feature 1..30: note = Hypo
  source 1..30: mol_type = genomic DNA

SEQ ID NO: 131405 - DNA, 36 bp, Homo sapiens; identical to SEQ ID NO: 100694
  misc_feature 1..36: note = chr9:138591435-138591471
  misc_feature 1..36: note = Hypo
  source 1..36: mol_type = genomic DNA

SEQ ID NO: 131406 - DNA, 30 bp, Homo sapiens; identical to SEQ ID NO: 42310
  misc_feature 1..30: note = chr9:138598276-138598306
  misc_feature 1..30: note = Hypo
  source 1..30: mol_type = genomic DNA

SEQ ID NO: 131407 - DNA, 611 bp, Homo sapiens
  misc_feature 1..611: note = chr9:138606154-138606765
  misc_feature 1..611: note = Hyper
  source 1..611: mol_type = genomic DNA
cctcctgccaggccccggggccgctttggagggagccccgccccctgcccctgcgcagcccccgccctagccccagcccggcgcagccggtcccgcgcgcccccgcccgcatgtgccgccaggcccgcccccgcccggccgcccgcccgcccggtgggtcgcggtggccgcgggctgcgctgcgcgggccgggcctggcgggccgggggctgcgcgcgtccgcgagggcgcccgacgcgggctgaggggcgctggcgtgtgcccgcaggcggccctgcgcgggggacggcgcgctcctggacaccgccggcttcaagatgagcgacctggactccgaggtgctgcccttgccgccgcgctaccgcttccgggacctgctgctgggcgacccgtccttccagaacgacgacaggtagggaccgggcgcggggtgggggctggggtcgccgtcccggcgccgccgcacgcccggagctgtccgcggtgctgacggccggtcccgcgcgcccccgcagccgccggcgcccttcaacttttcccggcttctggggacgcagaagtttcggagggggtgcgggcagggggaagcatcttctcgggagggggtctcc

SEQ ID NO: 131408 - DNA, 46 bp, Homo sapiens; identical to SEQ ID NO: 100698
  misc_feature 1..46: note = chr9:138607023-138607069
  misc_feature 1..46: note = Hyper
  source 1..46: mol_type = genomic DNA

SEQ ID NO: 131409 - DNA, 30 bp, Homo sapiens; identical to SEQ ID NO: 100699
  misc_feature 1..30: note = chr9:138610744-138610774
  misc_feature 1..30: note = Hypo
  source 1..30: mol_type = genomic DNA

SEQ ID NO: 131410 - DNA, 30 bp, Homo sapiens; identical to SEQ ID NO: 100700
  misc_feature 1..30: note = chr9:138617193-138617223
  misc_feature 1..30: note = Hypo
  source 1..30: mol_type = genomic DNA

SEQ ID NO: 131411 - DNA, 45 bp, Homo sapiens; identical to SEQ ID NO: 100701
  misc_feature 1..45: note = chr9:138627005-138627050
  misc_feature 1..45: note = Hypo
  source 1..45: mol_type = genomic DNA

SEQ ID NO: 131412 - DNA, 234 bp, Homo sapiens; identical to SEQ ID NO: 100702
  misc_feature 1..234: note = chr9:138627598-138627832
  misc_feature 1..234: note = Hypo
  source 1..234: mol_type = genomic DNA

SEQ ID NO: 131413 - DNA, 676 bp, Homo sapiens; identical to SEQ ID NO: 100703
  misc_feature 1..676: note = chr9:138628067-138628743
  misc_feature 1..676: note = Hyper
  source 1..676: mol_type = genomic DNA

SEQ ID NO: 131414 - DNA, 189 bp, Homo sapiens; identical to SEQ ID NO: 100704
  misc_feature 1..189: note = chr9:138634034-138634223
  misc_feature 1..189: note = Hypo
  source 1..189: mol_type = genomic DNA

SEQ ID NO: 131415 - DNA, 41 bp, Homo sapiens; identical to SEQ ID NO: 100705
  misc_feature 1..41: note = chr9:138636443-138636484
  misc_feature 1..41: note = Hypo
  source 1..41: mol_type = genomic DNA

SEQ ID NO: 131416 - DNA, 46 bp, Homo sapiens; identical to SEQ ID NO: 100706
  misc_feature 1..46: note = chr9:138637140-138637186
  misc_feature 1..46: note = Hypo
  source 1..46: mol_type = genomic DNA

SEQ ID NO: 131417 - DNA, 168 bp, Homo sapiens; identical to SEQ ID NO: 100707
  misc_feature 1..168: note = chr9:138637881-138638049
  misc_feature 1..168: note = Hypo
  source 1..168: mol_type = genomic DNA

SEQ ID NO: 131418 - DNA, 92 bp, Homo sapiens; identical to SEQ ID NO: 100708
  misc_feature 1..92: note = chr9:138642834-138642926
  misc_feature 1..92: note = Hypo
  source 1..92: mol_type = genomic DNA

SEQ ID NO: 131419 - DNA, 144 bp, Homo sapiens; identical to SEQ ID NO: 100709
  misc_feature 1..144: note = chr9:138650083-138650227
  misc_feature 1..144: note = Hypo
  source 1..144: mol_type = genomic DNA

SEQ ID NO: 131420 - DNA, 30 bp, Homo sapiens; identical to SEQ ID NO: 42316
  misc_feature 1..30: note = chr9:138651295-138651325
  misc_feature 1..30: note = Hypo
  source 1..30: mol_type = genomic DNA

SEQ ID NO: 131421 - DNA, 167 bp, Homo sapiens; identical to SEQ ID NO: 100711
  misc_feature 1..167: note = chr9:138651534-138651701
  misc_feature 1..167: note = Hypo
  source 1..167: mol_type = genomic DNA

SEQ ID NO: 131422 - DNA, 30 bp, Homo sapiens; identical to SEQ ID NO: 100712
  misc_feature 1..30: note = chr9:138653799-138653829
  misc_feature 1..30: note = Hypo
  source 1..30: mol_type = genomic DNA

SEQ ID NO: 131423 - DNA, 169 bp, Homo sapiens; identical to SEQ ID NO: 100713
  misc_feature 1..169: note = chr9:138655771-138655940
  misc_feature 1..169: note = Hypo
  source 1..169: mol_type = genomic DNA

SEQ ID NO: 131424 - DNA, 240 bp, Homo sapiens; identical to SEQ ID NO: 42319
  misc_feature 1..240: note = chr9:138659727-138659967
  misc_feature 1..240: note = Hypo
  source 1..240: mol_type = genomic DNA

SEQ ID NO: 131425 - DNA, 1191 bp, Homo sapiens; identical to SEQ ID NO: 100715
  misc_feature 1..1191: note = chr9:138660771-138661962
  misc_feature 1..1191: note = Hypo
  source 1..1191: mol_type = genomic DNA

SEQ ID NO: 131426 - DNA, 41 bp, Homo sapiens; identical to SEQ ID NO: 100716
  misc_feature 1..41: note = chr9:138662644-138662685
  misc_feature 1..41: note = Hypo
  source 1..41: mol_type = genomic DNA

SEQ ID NO: 131427 - DNA, 222 bp, Homo sapiens; identical to SEQ ID NO: 100717
  misc_feature 1..222: note = chr9:138666427-138666649
  misc_feature 1..222: note = Hypo
  source 1..222: mol_type = genomic DNA

SEQ ID NO: 131428 - DNA, 127 bp, Homo sapiens; identical to SEQ ID NO: 100718
  misc_feature 1..127: note = chr9:138670651-138670778
  misc_feature 1..127: note = Hypo
  source 1..127: mol_type = genomic DNA

SEQ ID NO: 131429 - DNA, 125 bp, Homo sapiens; identical to SEQ ID NO: 100719
  misc_feature 1..125: note = chr9:138671163-138671288
  misc_feature 1..125: note = Hypo
  source 1..125: mol_type = genomic DNA

SEQ ID NO: 131430 - DNA, 84 bp, Homo sapiens; identical to SEQ ID NO: 100720
  misc_feature 1..84: note = chr9:138675763-138675847
  misc_feature 1..84: note = Hypo
  source 1..84: mol_type = genomic DNA

SEQ ID NO: 131431 - DNA, 60 bp, Homo sapiens; identical to SEQ ID NO: 100721
  misc_feature 1..60: note = chr9:138678104-138678164
  misc_feature 1..60: note = Hypo
  source 1..60: mol_type = genomic DNA

SEQ ID NO: 131432 - DNA, 89 bp, Homo sapiens; identical to SEQ ID NO: 100722
  misc_feature 1..89: note = chr9:138678379-138678468
  misc_feature 1..89: note = Hypo
  source 1..89: mol_type = genomic DNA

SEQ ID NO: 131433 - DNA, 30 bp, Homo sapiens; identical to SEQ ID NO: 100723
  misc_feature 1..30: note = chr9:138679557-138679587
  misc_feature 1..30: note = Hypo
  source 1..30: mol_type = genomic DNA

SEQ ID NO: 131434 - DNA, 97 bp, Homo sapiens; identical to SEQ ID NO: 100724
  misc_feature 1..97: note = chr9:138680008-138680105
  misc_feature 1..97: note = Hypo
  source 1..97: mol_type = genomic DNA

SEQ ID NO: 131435 - DNA, 156 bp, Homo sapiens; identical to SEQ ID NO: 100725
  misc_feature 1..156: note = chr9:138688832-138688988
  misc_feature 1..156: note = Hypo
  source 1..156: mol_type = genomic DNA

SEQ ID NO: 131436 - DNA, 182 bp, Homo sapiens; identical to SEQ ID NO: 100726
  misc_feature 1..182: note = chr9:138743697-138743879
  misc_feature 1..182: note = Hypo
  source 1..182: mol_type = genomic DNA

SEQ ID NO: 131437 - DNA, 284 bp, Homo sapiens; identical to SEQ ID NO: 42327
  misc_feature 1..284: note = chr9:138780586-138780870
  misc_feature 1..284: note = Hypo
  source 1..284: mol_type = genomic DNA

SEQ ID NO: 131438 - DNA, 30 bp, Homo sapiens; identical to SEQ ID NO: 42328
  misc_feature 1..30: note = chr9:138781904-138781934
  misc_feature 1..30: note = Hypo
  source 1..30: mol_type = genomic DNA

SEQ ID NO: 131439 - DNA, 17 bp, Homo sapiens
  misc_feature 1..17: note = chr9:138812042-138812059
  misc_feature 1..17: note = Hypo
  source 1..17: mol_type = genomic DNA
ggcgggaggattgcttt

SEQ ID NO: 131440 - DNA, 58 bp, Homo sapiens; identical to SEQ ID NO: 100730
  misc_feature 1..58: note = chr9:138813127-138813185
  misc_feature 1..58: note = Hypo
  source 1..58: mol_type = genomic DNA

SEQ ID NO: 131441 - DNA, 32 bp, Homo sapiens; identical to SEQ ID NO: 100731
  misc_feature 1..32: note = chr9:138825931-138825963
  misc_feature 1..32: note = Hypo
  source 1..32: mol_type = genomic DNA

SEQ ID NO: 131442 - DNA, 323 bp, Homo sapiens; identical to SEQ ID NO: 100732
  misc_feature 1..323: note = chr9:138831815-138832138
  misc_feature 1..323: note = Hypo
  source 1..323: mol_type = genomic DNA

SEQ ID NO: 131443 - DNA, 139 bp, Homo sapiens; identical to SEQ ID NO: 100733
  misc_feature 1..139: note = chr9:138851512-138851651
  misc_feature 1..139: note = Hypo
  source 1..139: mol_type = genomic DNA

SEQ ID NO: 131444 - DNA, 124 bp, Homo sapiens; identical to SEQ ID NO: 100734
  misc_feature 1..124: note = chr9:138873414-138873538
  misc_feature 1..124: note = Hypo
  source 1..124: mol_type = genomic DNA

SEQ ID NO: 131445 - DNA, 30 bp, Homo sapiens; identical to SEQ ID NO: 100735
  misc_feature 1..30: note = chr9:138880956-138880986
  misc_feature 1..30: note = Hypo
  source 1..30: mol_type = genomic DNA

SEQ ID NO: 131446 - DNA, 51 bp, Homo sapiens; identical to SEQ ID NO: 100736
  misc_feature 1..51: note = chr9:138970797-138970848
  misc_feature 1..51: note = Hypo
  source 1..51: mol_type = genomic DNA

SEQ ID NO: 131447 - DNA, 30 bp, Homo sapiens; identical to SEQ ID NO: 100737
  misc_feature 1..30: note = chr9:138986039-138986069
  misc_feature 1..30: note = Hyper
  source 1..30: mol_type = genomic DNA

SEQ ID NO: 131448 - DNA, 61 bp, Homo sapiens; identical to SEQ ID NO: 100738
  misc_feature 1..61: note = chr9:138986272-138986333
  misc_feature 1..61: note = Hyper
  source 1..61: mol_type = genomic DNA

SEQ ID NO: 131449 - DNA, 76 bp, Homo sapiens; identical to SEQ ID NO: 100739
  misc_feature 1..76: note = chr9:138991914-138991990
  misc_feature 1..76: note = Hypo
  source 1..76: mol_type = genomic DNA

SEQ ID NO: 131450 - DNA, 87 bp, Homo sapiens; identical to SEQ ID NO: 42332
  misc_feature 1..87: note = chr9:138994353-138994440
  misc_feature 1..87: note = Hypo
  source 1..87: mol_type = genomic DNA

SEQ ID NO: 131451 - DNA, 275 bp, Homo sapiens; identical to SEQ ID NO: 100741
  misc_feature 1..275: note = chr9:139000396-139000671
  misc_feature 1..275: note = Hypo
  source 1..275: mol_type = genomic DNA

SEQ ID NO: 131452 - DNA, 234 bp, Homo sapiens; identical to SEQ ID NO: 100742
  misc_feature 1..234: note = chr9:139012272-139012506
  misc_feature 1..234: note = Hypo
  source 1..234: mol_type = genomic DNA

SEQ ID NO: 131453 - DNA, 576 bp, Homo sapiens
  misc_feature 1..576: note = chr9:139024359-139024935
  misc_feature 1..576: note = Hyper
  source 1..576: mol_type = genomic DNA
ctccccttcccactgcgcccccgcgtccctgcagccaggggtgcgcgccccgccgcccagtcctgggatggagctgggaaacgcccgctgcggggtgcctgggacccccgaaggcgtcgggagttgggggcaaacggccgccgccggcccgcgtcaggcgcccggcctcgctggggccgcggctcggctgggtccccccactccgggtccggctgaatctccatcctccctgtgcggctcctgcaccccggcgaacctggctctctctgtgcctcagtttactcctgaggtccgctgagcaggaagtgcagccctggctccgggacctcagcccgaggccggcgctgctgcggagcacaggcctcctgaggccgccccacgcgcaggggcgctgcagagcgcggagcccgggagctcgcaccgcctgttcgtggggtccctggggtgcaggggtggaggacataggagtgtgggggtcgtgggcagacccaggcgggacgctgtgccagtgccgccccgaaggcccagtgcgcagggtcccccgcgccccagagcctgccccgcccctacgccggt

SEQ ID NO: 131454 - DNA, 175 bp, Homo sapiens; identical to SEQ ID NO: 100745
  misc_feature 1..175: note = chr9:139025288-139025463
  misc_feature 1..175: note = Hyper
  source 1..175: mol_type = genomic DNA

SEQ ID NO: 131455 - DNA, 62 bp, Homo sapiens; identical to SEQ ID NO: 100746
  misc_feature 1..62: note = chr9:139025663-139025725
  misc_feature 1..62: note = Hyper
  source 1..62: mol_type = genomic DNA

SEQ ID NO: 131456 - DNA, 113 bp, Homo sapiens; identical to SEQ ID NO: 100747
  misc_feature 1..113: note = chr9:139030628-139030741
  misc_feature 1..113: note = Hyper
  source 1..113: mol_type = genomic DNA

SEQ ID NO: 131457 - DNA, 241 bp, Homo sapiens; identical to SEQ ID NO: 100748
  misc_feature 1..241: note = chr9:139045484-139045725
  misc_feature 1..241: note = Hypo
  source 1..241: mol_type = genomic DNA

SEQ ID NO: 131458 - DNA, 173 bp, Homo sapiens; identical to SEQ ID NO: 100749
  misc_feature 1..173: note = chr9:139047509-139047682
  misc_feature 1..173: note = Hypo
  source 1..173: mol_type = genomic DNA

SEQ ID NO: 131459 - DNA, 30 bp, Homo sapiens; identical to SEQ ID NO: 100750
  misc_feature 1..30: note = chr9:139068966-139068996
  misc_feature 1..30: note = Hypo
  source 1..30: mol_type = genomic DNA

SEQ ID NO: 131460 - DNA, 39 bp, Homo sapiens; identical to SEQ ID NO: 100751
  misc_feature 1..39: note = chr9:139069965-139070004
  misc_feature 1..39: note = Hypo
  source 1..39: mol_type = genomic DNA

SEQ ID NO: 131461 - DNA, 147 bp, Homo sapiens; identical to SEQ ID NO: 100752
  misc_feature 1..147: note = chr9:139077555-139077702
  misc_feature 1..147: note = Hypo
  source 1..147: mol_type = genomic DNA

SEQ ID NO: 131462 - DNA, 156 bp, Homo sapiens; identical to SEQ ID NO: 100753
  misc_feature 1..156: note = chr9:139078945-139079101
  misc_feature 1..156: note = Hypo
  source 1..156: mol_type = genomic DNA

SEQ ID NO: 131463 - DNA, 1613 bp, Homo sapiens
  misc_feature 1..1613: note = chr9:139084546-139086159
  misc_feature 1..1613: note = Hyper
  source 1..1613: mol_type = genomic DNA
tgccacccccagccccgcccccgctgcaagggggatggggtcctgggcaagggtcggtcctctctggtcagcgaccccgctgcctctcgggtcgggaccccaacgagcgggaaaaaaaaaaaaagacagaacgcgtgccggggagtatgaccccggccccggctccctgcaccccgggctgcgcagagccctcgccctccgggttccctctgccagcgacgccagcagagccgggcaggtcccatctcggggtctccccgcgcccggacgacccctctcccactgcggccccggccctgcctcacccgccgccccaccagggtccgagaccgggagaccccagccgcggggggggggggacatcagccttcgacctgcccccgcacctcccgctccgcggggagactgggcgccaggaaccccgaattcggggctgacaacccgcaggcgcgcggctaaagcttccaccgtccgcgagaaggcgtctccaccctggaaggaagggggctcggacccagggaggatgaggggtccgccttctccttcccctcacctcgctgcagcccagagcccgcagacagccccgcggcccaaggtctctctccgcccgaggtctgcagctctggctgggcgtcccccggcctggcgggggtccgggtgggggccgcggcccgaagtctgattctgggttcgccctcgcgggtacggagcaggagccggaggaggtcggagcccgcgtttctgtccctggggcgcggggaggtcacagggctccccccaggcccgcgcggggcggaaccgggtacggccagagcggcgcgcgctgcgctccgatcgggaaccggaggccggcgaggtcacgcagacgcgctctccagggcaccgcgggtctcccatcgccgaggccgcctccgcaggccccgctcccctccccgcggcggccagggcggtgtcgggggcggccacgggctccgggattatcgacgcgccgccagctggagcgggcgcgggcggggtccccgcgggaacagtcggcactttattaacctgtcagcgcctaaaaggtcccgggcggcctgggggaggggccggaggccggggcggggtgggggcgcggctgggggatttgcgccccctcctcggggctgccccccgccagcccgcgctgcaccccggcggccgcgccccctccctaaattccgccttcgacctgggcccggagccgctttccccgcgggctgcccgttgcccccggagagttcggggtcgtccctccagcgcccgtccctggccgcggggccgctggctggagtctctgccctggggacaccgactccgcaggccggccccgaacctcgcactttcccgccggcgcgcctttgcccgcactggtcgccgtcgccacgcgccatcctcgcgtccaaccccatctgcttccacgctcggctccagtgttgccgccattcccagtggccgtcggggcccttctcccctcccgggaccgccctggtgatccgcgcgtctctgcgcttcccaggggtgctcggtgcctccttagacacagcgtggctgccagagcctgggggtcgaaggccatgcgccacagggaggga

SEQ ID NO: 131464 - DNA, 531 bp, Homo sapiens; identical to SEQ ID NO: 100757
  misc_feature 1..531: note = chr9:139089100-139089631
  misc_feature 1..531: note = Hyper
  source 1..531: mol_type = genomic DNA

SEQ ID NO: 131465 - DNA, 1259 bp, Homo sapiens
  misc_feature 1..1259: note = chr9:139090405-139091664
  misc_feature 1..1259: note = Hyper
  source 1..1259: mol_type = genomic DNA
tgggaaattcagatccgcgggctccctgggacccctgcgaccccgccgacgcgcgctcgtccccccccgagctccgcgatccctccgcctaccggggaaggagacctcagcgtcgctgtcctgcccctcctgaacgctgtccttgtccgacttggagccgccgcgggagcgcttcatgttgcggaaatactgcccccagcgctgccggccggcgtccttcttcagcctcttctccttggcccggcggttctggaaccaaacctgggggcggggcggggtgagcggccgcccggctctgcgggggcccccaaggccgcgggcgggagggaagcaggggcgagcgctgacctgcaccacgcgcatgtccaggcccgtctcggacgagagctgctcgcgcacgtggcgcgccggcttgggcgaggtgttgtaagcgctcttcagcgtctccagctgcttggcggtgatggtcgtgcgcggccgcttggccgtggcctcggcctctgcgcggcgggcgagcggtgaggcgcggcagcccctccggccccggccggacccccagccctcccaccccggccggcgcggggacgtcggggcctcaggtgcccacccccatcccgccccacaggcttctcggaaggcgcgggcgctgggagcgattggcaaaaacgggcagcacccgggctggggtggagggggcgccggcggagggcgggttctgccgcgggggcgggggcggcgccttccctaaaatcgcacctccacggcgcccccgccttcagccttggctcccttctccaagcaccctgatttccccgcgggctcccctttattctaagggtgtgggtatggcccagccttcgcggccaagaatttagggcgataattccgaccaggggcgaaaagccgcacacttcggaccgaacgaagcggttcgggacgcgggtctgtccgtgactccgccgttcccggcctcggcttcctgctgcctacaccgccctagcccaggcccccttagtgagcgcttggggagagaatttccccggacgcccccctgggcgtggcctcagccccatttttttcagaccaggaaaggtgggagcgtcgtcccctcggctgacctcgctgcttggcggtttcgtagtccgccttgcacacgagccggctgtcctccatgaggtagaactcgtcgcccgtggccagctgccgcttgcacacgacgcaggcaaagcagtgcaggtggtacacgaagtcctgggcgc

SEQ ID NO: 131466 - DNA, 665 bp, Homo sapiens
  misc_feature 1..665: note = chr9:139093534-139094199
  misc_feature 1..665: note = Hyper
  source 1..665: mol_type = genomic DNA
aggaaggggctccctcgacctccggcggaaaaaactgggctgcgcctccccacgcagtggcgggaaaccggcgatgaatgcgccccgcatccggcaaaaccgcagctccgggtgcggagcgtcgaggacccgctgcgcgcccggggtccccatcgtgggcagcgatcgcaggcgaggacccggctcggagcggggcggcccgacaggccgacacagcgcggattcagcaccgcggaccggacagcgcctcggccgcagctcgccgccggcgcccgcgtcgggcaaaagccgccccagcccaccccgcgccgcgcccgcgaccccagccttacgctgcatggcgactccagccctggcgggggctcctgtgtcagggatggcggggtcggcggagcctggacgccagcccgcccgctccggccagctctcccgagcgcgggcgcgcagtcctccttcctccctccctctctccgccccccagcccccgcggccaacccctcccaggaaccgtcgaaaaataaataaataagtagggaaccgcgagcccccacagcctggatgtaacccccttcccgccggccggtccctctcactccccactggctccggggcctccttccccatcctgcggctccagctggcccgggagtcgaggagaactgccc

SEQ ID NO: 131467 - DNA, 850 bp, Homo sapiens
  misc_feature 1..850: note = chr9:139094635-139095485
  misc_feature 1..850: note = Hyper
  source 1..850: mol_type = genomic DNA
aaatacaggctgaggcgcccaggcgcggacgttccggggtcctcgcgcccactcccgcccagatcctctagctcctgccagcctccgcggccaggcccggaaaggcctgaggatctcctggtctccccggtgcagccactcggcccgggcacccacctcggcgcaggtccgccctccgcgccagcagtgctagcagcaggtcgcctcccgccgactcccgggccgggcccagctccccgcgcgcctccatgggtcccgccgcccggcgtcgccactctccagtcccgaactttcccgggcccagcgacgccaccccgcaatagccccgaaccggcgtccaagcgactccgggtgctgctgggcgctgcgcccgcgggccgccctggggcccggagcctctggccgagcggagggcggagcggccggggggcggggccgcggggcggggcggggccgggggtcgcggagaccagcccgggccactgcggactctgagcgcctttgcgccgggacctgcggtgcccagaggccgccccgcgtgcccggcccgagggcgggcaccggtaagggagggcccaggtcagggcttcccgccagcgttcgtcccggccccgcagcttcctgcgccggagcggcccagaggcagaggcctgagctggagcacacgccaggagggctaaggttcccgggagaggggtcgagaaggcagcagggtcctcccgccgctgaggtttggcctcgggagcagcagatggtcggcgggagctcaacccgaaacgcagaaggggtgagtgtggcgccgagggctgcgtaccggaaccgcaaggtgccggaccgatcccagatgcta

SEQ ID NO: 131468 - DNA, 637 bp, Homo sapiens; identical to SEQ ID NO: 100766
  misc_feature 1..637: note = chr9:139096558-139097195
  misc_feature 1..637: note = Hyper
  source 1..637: mol_type = genomic DNA

SEQ ID NO: 131469 - DNA, 249 bp, Homo sapiens; identical to SEQ ID NO: 100767
  misc_feature 1..249: note = chr9:139100373-139100622
  misc_feature 1..249: note = Hypo
  source 1..249: mol_type = genomic DNA

SEQ ID NO: 131470 - DNA, 113 bp, Homo sapiens; identical to SEQ ID NO: 100768
  misc_feature 1..113: note = chr9:139103518-139103631
  misc_feature 1..113: note = Hypo
  source 1..113: mol_type = genomic DNA

SEQ ID NO: 131471 - DNA, 223 bp, Homo sapiens; identical to SEQ ID NO: 100769
  misc_feature 1..223: note = chr9:139111161-139111384
  misc_feature 1..223: note = Hypo
  source 1..223: mol_type = genomic DNA

SEQ ID NO: 131472 - DNA, 30 bp, Homo sapiens; identical to SEQ ID NO: 100770
  misc_feature 1..30: note = chr9:139114451-139114481
  misc_feature 1..30: note = Hypo
  source 1..30: mol_type = genomic DNA

SEQ ID NO: 131473 - DNA, 55 bp, Homo sapiens; identical to SEQ ID NO: 100771
  misc_feature 1..55: note = chr9:139133128-139133183
  misc_feature 1..55: note = Hypo
  source 1..55: mol_type = genomic DNA

SEQ ID NO: 131474 - DNA, 161 bp, Homo sapiens; identical to SEQ ID NO: 100772
  misc_feature 1..161: note = chr9:139265268-139265429
  misc_feature 1..161: note = Hypo
  source 1..161: mol_type = genomic DNA

SEQ ID NO: 131475 - DNA, 90 bp, Homo sapiens; identical to SEQ ID NO: 100773
  misc_feature 1..90: note = chr9:139268822-139268912
  misc_feature 1..90: note = Hypo
  source 1..90: mol_type = genomic DNA

SEQ ID NO: 131476 - DNA, 212 bp, Homo sapiens; identical to SEQ ID NO: 100774
  misc_feature 1..212: note = chr9:139317654-139317866
  misc_feature 1..212: note = Hypo
  source 1..212: mol_type = genomic DNA

SEQ ID NO: 131477 - DNA, 40 bp, Homo sapiens; identical to SEQ ID NO: 100775
  misc_feature 1..40: note = chr9:139367918-139367958
  misc_feature 1..40: note = Hypo
  source 1..40: mol_type = genomic DNA

SEQ ID NO: 131478 - DNA, 31 bp, Homo sapiens; identical to SEQ ID NO: 100776
  misc_feature 1..31: note = chr9:139375341-139375372
  misc_feature 1..31: note = Hypo
  source 1..31: mol_type = genomic DNA

SEQ ID NO: 131479 - DNA, 28 bp, Homo sapiens
  misc_feature 1..28: note = chr9:139375871-139375899
  misc_feature 1..28: note = Hypo
  source 1..28: mol_type = genomic DNA
gagccaccgcgcccggcccagggaattt

SEQ ID NO: 131480 - DNA, 57 bp, Homo sapiens; identical to SEQ ID NO: 100778
  misc_feature 1..57: note = chr9:139403416-139403473
  misc_feature 1..57: note = Hypo
  source 1..57: mol_type = genomic DNA

SEQ ID NO: 131481 - DNA, 30 bp, Homo sapiens; identical to SEQ ID NO: 42346
  misc_feature 1..30: note = chr9:139412504-139412534
  misc_feature 1..30: note = Hypo
  source 1..30: mol_type = genomic DNA

SEQ ID NO: 131482 - DNA, 30 bp, Homo sapiens; identical to SEQ ID NO: 42347
  misc_feature 1..30: note = chr9:139419942-139419972
  misc_feature 1..30: note = Hypo
  source 1..30: mol_type = genomic DNA

SEQ ID NO: 131483 - DNA, 229 bp, Homo sapiens; identical to SEQ ID NO: 100781
  misc_feature 1..229: note = chr9:139421894-139422123
  misc_feature 1..229: note = Hypo
  source 1..229: mol_type = genomic DNA

SEQ ID NO: 131484 - DNA, 127 bp, Homo sapiens; identical to SEQ ID NO: 100782
  misc_feature 1..127: note = chr9:139471982-139472109
  misc_feature 1..127: note = Hypo
  source 1..127: mol_type = genomic DNA

SEQ ID NO: 131485 - DNA, 40 bp, Homo sapiens; identical to SEQ ID NO: 15284
  misc_feature 1..40: note = chr9:139472499-139472539
  misc_feature 1..40: note = Hypo
  source 1..40: mol_type = genomic DNA

SEQ ID NO: 131486 - DNA, 30 bp, Homo sapiens
  misc_feature 1..30: note = chr9:139482802-139482832
  misc_feature 1..30: note = Hyper
  source 1..30: mol_type = genomic DNA
gggcgatgggagcagcggaggagcccaggc

SEQ ID NO: 131487 - DNA, 30 bp, Homo sapiens; identical to SEQ ID NO: 42350
  misc_feature 1..30: note = chr9:139487465-139487495
  misc_feature 1..30: note = Hypo
  source 1..30: mol_type = genomic DNA

SEQ ID NO: 131488 - DNA, 114 bp, Homo sapiens
  misc_feature 1..114: note = chr9:139491047-139491161
  misc_feature 1..114: note = Hypo
  source 1..114: mol_type = genomic DNA
cccggctgccgtgtgcgggccctgggtaacaaaagtgattgtgtacttgaggaaaggagacggttatgagaaacactccccgttacagcattttacgttcgcagggaaaatgcc

SEQ ID NO: 131489 - DNA, 51 bp, Homo sapiens; identical to SEQ ID NO: 100788
  misc_feature 1..51: note = chr9:139501991-139502042
  misc_feature 1..51: note = Hypo
  source 1..51: mol_type = genomic DNA

SEQ ID NO: 131490 - DNA, 30 bp, Homo sapiens; identical to SEQ ID NO: 42351
  misc_feature 1..30: note = chr9:139504374-139504404
  misc_feature 1..30: note = Hypo
  source 1..30: mol_type = genomic DNA

SEQ ID NO: 131491 - DNA, 170 bp, Homo sapiens; identical to SEQ ID NO: 100790
  misc_feature 1..170: note = chr9:139504817-139504987
  misc_feature 1..170: note = Hypo
  source 1..170: mol_type = genomic DNA

SEQ ID NO: 131492 - DNA, 101 bp, Homo sapiens; identical to SEQ ID NO: 42353
  misc_feature 1..101: note = chr9:139505621-139505722
  misc_feature 1..101: note = Hypo
  source 1..101: mol_type = genomic DNA

SEQ ID NO: 131493 - DNA, 76 bp, Homo sapiens; identical to SEQ ID NO: 42354
  misc_feature 1..76: note = chr9:139506440-139506516
  misc_feature 1..76: note = Hypo
  source 1..76: mol_type = genomic DNA

SEQ ID NO: 131494 - DNA, 30 bp, Homo sapiens; identical to SEQ ID NO: 42355
  misc_feature 1..30: note = chr9:139517238-139517268
  misc_feature 1..30: note = Hypo
  source 1..30: mol_type = genomic DNA

SEQ ID NO: 131495 - DNA, 33 bp, Homo sapiens; identical to SEQ ID NO: 100794
  misc_feature 1..33: note = chr9:139535581-139535614
  misc_feature 1..33: note = Hypo
  source 1..33: mol_type = genomic DNA

SEQ ID NO: 131496 - DNA, 151 bp, Homo sapiens; identical to SEQ ID NO: 100795
  misc_feature 1..151: note = chr9:139546454-139546605
  misc_feature 1..151: note = Hypo
  source 1..151: mol_type = genomic DNA

SEQ ID NO: 131497 - DNA, 52 bp, Homo sapiens; identical to SEQ ID NO: 100796
  misc_feature 1..52: note = chr9:139560006-139560058
  misc_feature 1..52: note = Hyper
  source 1..52: mol_type = genomic DNA

SEQ ID NO: 131498 - DNA, 429 bp, Homo sapiens; identical to SEQ ID NO: 100797
  misc_feature 1..429: note = chr9:139606291-139606720
  misc_feature 1..429: note = Hyper
  source 1..429: mol_type = genomic DNA

SEQ ID NO: 131499 - DNA, 336 bp, Homo sapiens; identical to SEQ ID NO: 100798
  misc_feature 1..336: note = chr9:139606963-139607299
  misc_feature 1..336: note = Hyper
  source 1..336: mol_type = genomic DNA

SEQ ID NO: 131500 - DNA, 180 bp, Homo sapiens; identical to SEQ ID NO: 100799
  misc_feature 1..180: note = chr9:139634047-139634227
  misc_feature 1..180: note = Hypo
  source 1..180: mol_type = genomic DNA

SEQ ID NO: 131501 - DNA, 30 bp, Homo sapiens; identical to SEQ ID NO: 100800
  misc_feature 1..30: note = chr9:139634437-139634467
  misc_feature 1..30: note = Hypo
  source 1..30: mol_type = genomic DNA

SEQ ID NO: 131502 - DNA, 195 bp, Homo sapiens; identical to SEQ ID NO: 100801
  misc_feature 1..195: note = chr9:139638343-139638538
  misc_feature 1..195: note = Hypo
  source 1..195: mol_type = genomic DNA

SEQ ID NO: 131503 - DNA, 138 bp, Homo sapiens; identical to SEQ ID NO: 42359
  misc_feature 1..138: note = chr9:139654706-139654844
  misc_feature 1..138: note = Hypo
  source 1..138: mol_type = genomic DNA

SEQ ID NO: 131504 - DNA, 179 bp, Homo sapiens; identical to SEQ ID NO: 100803
  misc_feature 1..179: note = chr9:139662229-139662408
  misc_feature 1..179: note = Hypo
  source 1..179: mol_type = genomic DNA

SEQ ID NO: 131505 - DNA, 595 bp, Homo sapiens; identical to SEQ ID NO: 42361
  misc_feature 1..595: note = chr9:139698658-139699253
  misc_feature 1..595: note = Hypo
  source 1..595: mol_type = genomic DNA

SEQ ID NO: 131506 - DNA, 30 bp, Homo sapiens; identical to SEQ ID NO: 100805
  misc_feature 1..30: note = chr9:139701246-139701276
  misc_feature 1..30: note = Hypo
  source 1..30: mol_type = genomic DNA

SEQ ID NO: 131507 - DNA, 87 bp, Homo sapiens; identical to SEQ ID NO: 100806
  misc_feature 1..87: note = chr9:139703836-139703923
  misc_feature 1..87: note = Hypo
  source 1..87: mol_type = genomic DNA

SEQ ID NO: 131508 - DNA, 387 bp, Homo sapiens; identical to SEQ ID NO: 100807
  misc_feature 1..387: note = chr9:139704043-139704430
  misc_feature 1..387: note = Hypo
  source 1..387: mol_type = genomic DNA

SEQ ID NO: 131509 - DNA, 99 bp, Homo sapiens; identical to SEQ ID NO: 42364
  misc_feature 1..99: note = chr9:139705312-139705411
  misc_feature 1..99: note = Hypo
  source 1..99: mol_type = genomic DNA

SEQ ID NO: 131510 - DNA, 98 bp, Homo sapiens; identical to SEQ ID NO: 42365
  misc_feature 1..98: note = chr9:139714085-139714183
  misc_feature 1..98: note = Hypo
  source 1..98: mol_type = genomic DNA

SEQ ID NO: 131511 - DNA, 333 bp, Homo sapiens; identical to SEQ ID NO: 100810
  misc_feature 1..333: note = chr9:139717731-139718064
  misc_feature 1..333: note = Hypo
  source 1..333: mol_type = genomic DNA

SEQ ID NO: 131512 - DNA, 34 bp, Homo sapiens; identical to SEQ ID NO: 100811
  misc_feature 1..34: note = chr9:139721948-139721982
  misc_feature 1..34: note = Hypo
  source 1..34: mol_type = genomic DNA

SEQ ID NO: 131513 - DNA, 191 bp, Homo sapiens; identical to SEQ ID NO: 100812
  misc_feature 1..191: note = chr9:139734907-139735098
  misc_feature 1..191: note = Hypo
  source 1..191: mol_type = genomic DNA

SEQ ID NO: 131514 - DNA, 36 bp, Homo sapiens; identical to SEQ ID NO: 100813
  misc_feature 1..36: note = chr9:139735532-139735568
  misc_feature 1..36: note = Hypo
  source 1..36: mol_type = genomic DNA

SEQ ID NO: 131515 - DNA, 448 bp, Homo sapiens
  misc_feature 1..448: note = chr9:139739053-139739501
  misc_feature 1..448: note = Hyper
  source 1..448: mol_type = genomic DNA
ccatggagaccctgccggagccaccgccgccggagtccgctgtgccgcgcgcccggacccgcgaagccgagccacgccgccgcgcccgctccaagagtgcgccccgcgcgcccccgggcctgacgcccgcgcccgcctcgccgccggtgttgccccgccgagggcgggaggcccagcgtgcggcgcgggccgaggcatcgccgcgccgggagcccgcgtacccggcgctccgcgcccttgccaacgagctgcatcccatcaagttgcagccgcagcggggcggccccggccgcgtcgcgcccctgtgcgccgccgcgggccgctgcgcaccgcccgagccacccgcgggtcccgccccccacgtgcgctgccgcctggacatcaagccagacgacgcagtgctccagcacgccacccggggctcgcggtcctgcgggcccaccgaggc

SEQ ID NO: 131516 - DNA, 265 bp, Homo sapiens
  misc_feature 1..265: note = chr9:139740567-139740832
  misc_feature 1..265: note = Hyper
  source 1..265: mol_type = genomic DNA
ggccccacctctggccgccagcggagcctagagcagctggacgagctcatcacggacctggtcatcgactcgcgacccaccgccggccaggcctcagagcccgcggccgactgcctgggcccccaactgcgccgactgctggactcgcggcccgcgggctccggggcccccgcgctggcgccgccacgctcgccccccgcctcggccggcagcgccgaggagcccgcggccccgggagaggcggccgacgcgtcccccgaaccca

SEQ ID NO: 131517 - DNA, 379 bp, Homo sapiens
  misc_feature 1..379: note = chr9:139741076-139741455
  misc_feature 1..379: note = Hyper
  source 1..379: mol_type = genomic DNA
gcgcatcgcgcgtgtcggcttcctgtcgcgcggccgcggcgtgctcttcctgggcttcccaagtccaggctcggccgacaacttcctgcgctttggcctggaggggctgctgctatcccccacctacctatcgctgcgtgagctggccacacacgcggcgcccctgggcagctacgcgcgcgagctggcggccgctgggcgcctctacgaaccggcagagtgcttcctgctcagcgtgtccgtggccgtgggacccggcaccgcgccaccggggacaccggccctgcccgcgcccgcgccacgcagccacgggccaacagtgcgcaagttcgccaaggtagcgctggcggccggcagccccgcgcggccgcccccggcg

SEQ ID NO: 131518 - DNA, 96 bp, Homo sapiens; identical to SEQ ID NO: 100818
  misc_feature 1..96: note = chr9:139741718-139741814
  misc_feature 1..96: note = Hyper
  source 1..96: mol_type = genomic DNA

SEQ ID NO: 131519 - DNA, 30 bp, Homo sapiens; identical to SEQ ID NO: 100819
  misc_feature 1..30: note = chr9:139752642-139752672
  misc_feature 1..30: note = Hypo
  source 1..30: mol_type = genomic DNA

SEQ ID NO: 131520 - DNA, 24 bp, Homo sapiens
  misc_feature 1..24: note = chr9:139761759-139761783
  misc_feature 1..24: note = Hypo
  source 1..24: mol_type = genomic DNA
atgaaactgcgtttcaaaaaaaaa

SEQ ID NO: 131521 - DNA, 40 bp, Homo sapiens; identical to SEQ ID NO: 100821
  misc_feature 1..40: note = chr9:139779368-139779408
  misc_feature 1..40: note = Hypo
  source 1..40: mol_type = genomic DNA

SEQ ID NO: 131522 - DNA, 30 bp, Homo sapiens; identical to SEQ ID NO: 100822
  misc_feature 1..30: note = chr9:139779692-139779722
  misc_feature 1..30: note = Hypo
  source 1..30: mol_type = genomic DNA

SEQ ID NO: 131523 - DNA, 120 bp, Homo sapiens; identical to SEQ ID NO: 100823
  misc_feature 1..120: note = chr9:139782635-139782755
  misc_feature 1..120: note = Hypo
  source 1..120: mol_type = genomic DNA

SEQ ID NO: 131524 - DNA, 63 bp, Homo sapiens; identical to SEQ ID NO: 100824
  misc_feature 1..63: note = chr9:139793127-139793190
  misc_feature 1..63: note = Hypo
  source 1..63: mol_type = genomic DNA

SEQ ID NO: 131525 - DNA, 104 bp, Homo sapiens; identical to SEQ ID NO: 42369
  misc_feature 1..104: note = chr9:139794879-139794983
  misc_feature 1..104: note = Hypo
  source 1..104: mol_type = genomic DNA

SEQ ID NO: 131526 - DNA, 444 bp, Homo sapiens; identical to SEQ ID NO: 100826
  misc_feature 1..444: note = chr9:139809719-139810163
  misc_feature 1..444: note = Hypo
  source 1..444: mol_type = genomic DNA

SEQ ID NO: 131527 - DNA, 282 bp, Homo sapiens; identical to SEQ ID NO: 42371
  misc_feature 1..282: note = chr9:139818340-139818622
  misc_feature 1..282: note = Hypo
  source 1..282: mol_type = genomic DNA

SEQ ID NO: 131528 - DNA, 206 bp, Homo sapiens; identical to SEQ ID NO: 100828
  misc_feature 1..206: note = chr9:139836762-139836968
  misc_feature 1..206: note = Hypo
  source 1..206: mol_type = genomic DNA

SEQ ID NO: 131529 - DNA, 88 bp, Homo sapiens; identical to SEQ ID NO: 100829
  misc_feature 1..88: note = chr9:139856294-139856382
  misc_feature 1..88: note = Hypo
  source 1..88: mol_type = genomic DNA

SEQ ID NO: 131530 - DNA, 30 bp, Homo sapiens; identical to SEQ ID NO: 100830
  misc_feature 1..30: note = chr9:139858592-139858622
  misc_feature 1..30: note = Hypo
  source 1..30: mol_type = genomic DNA

SEQ ID NO: 131531 - DNA, 227 bp, Homo sapiens; identical to SEQ ID NO: 15294
  misc_feature 1..227: note = chr9:139859041-139859268
  misc_feature 1..227: note = Hypo
  source 1..227: mol_type = genomic DNA

SEQ ID NO: 131532 - DNA, 311 bp, Homo sapiens; identical to SEQ ID NO: 100832
  misc_feature 1..311: note = chr9:139872509-139872820
  misc_feature 1..311: note = Hyper
  source 1..311: mol_type = genomic DNA

SEQ ID NO: 131533 - DNA, 64 bp, Homo sapiens; identical to SEQ ID NO: 100833
  misc_feature 1..64: note = chr9:139879955-139880019
  misc_feature 1..64: note = Hyper
  source 1..64: mol_type = genomic DNA

SEQ ID NO: 131534 - DNA, 30 bp, Homo sapiens
  misc_feature 1..30: note = chr9:139880323-139880353
  misc_feature 1..30: note = Hyper
  source 1..30: mol_type = genomic DNA
tagcccaggagggaccgagcctcggctccg

SEQ ID NO: 131535 - DNA, 55 bp, Homo sapiens; identical to SEQ ID NO: 100835
  misc_feature 1..55: note = chr9:139885973-139886028
  misc_feature 1..55: note = Hypo
  source 1..55: mol_type = genomic DNA

SEQ ID NO: 131536 - DNA, 30 bp, Homo sapiens; identical to SEQ ID NO: 100836
  misc_feature 1..30: note = chr9:139886617-139886647
  misc_feature 1..30: note = Hyper
  source 1..30: mol_type = genomic DNA

SEQ ID NO: 131537 - DNA, 340 bp, Homo sapiens; identical to SEQ ID NO: 100837
  misc_feature 1..340: note = chr9:139888764-139889104
  misc_feature 1..340: note = Hypo
  source 1..340: mol_type = genomic DNA

SEQ ID NO: 131538 - DNA, 61 bp, Homo sapiens; identical to SEQ ID NO: 100838
  misc_feature 1..61: note = chr9:139902974-139903035
  misc_feature 1..61: note = Hypo
  source 1..61: mol_type = genomic DNA

SEQ ID NO: 131539 - DNA, 295 bp, Homo sapiens; identical to SEQ ID NO: 100839
  misc_feature 1..295: note = chr9:139904237-139904532
  misc_feature 1..295: note = Hypo
  source 1..295: mol_type = genomic DNA

SEQ ID NO: 131540 - DNA, 39 bp, Homo sapiens; identical to SEQ ID NO: 100840
  misc_feature 1..39: note = chr9:139913362-139913401
  misc_feature 1..39: note = Hypo
  source 1..39: mol_type = genomic DNA

SEQ ID NO: 131541 - DNA, 345 bp, Homo sapiens; identical to SEQ ID NO: 100841
  misc_feature 1..345: note = chr9:139915848-139916193
  misc_feature 1..345: note = Hypo
  source 1..345: mol_type = genomic DNA

SEQ ID NO: 131542 - DNA, 154 bp, Homo sapiens; identical to SEQ ID NO: 100842
  misc_feature 1..154: note = chr9:139943348-139943502
  misc_feature 1..154: note = Hyper
  source 1..154: mol_type = genomic DNA

SEQ ID NO: 131543 - DNA, 230 bp, Homo sapiens; identical to SEQ ID NO: 100843
  misc_feature 1..230: note = chr9:139948020-139948250
  misc_feature 1..230: note = Hyper
  source 1..230: mol_type = genomic DNA

SEQ ID NO: 131544 - DNA, 124 bp, Homo sapiens; identical to SEQ ID NO: 100844
  misc_feature 1..124: note = chr9:139971509-139971633
  misc_feature 1..124: note = Hyper
  source 1..124: mol_type = genomic DNA

SEQ ID NO: 131545 - DNA, 119 bp, Homo sapiens; identical to SEQ ID NO: 100845
  misc_feature 1..119: note = chr9:139972624-139972743
  misc_feature 1..119: note = Hyper
  source 1..119: mol_type = genomic DNA

SEQ ID NO: 131546 - DNA, 105 bp, Homo sapiens; identical to SEQ ID NO: 100846
  misc_feature 1..105: note = chr9:139978936-139979041
  misc_feature 1..105: note = Hypo
  source 1..105: mol_type = genomic DNA

SEQ ID NO: 131547 - DNA, 478 bp, Homo sapiens
  misc_feature 1..478: note = chr9:140024612-140025090
  misc_feature 1..478: note = Hyper
  source 1..478: mol_type = genomic DNA
gcccagggcctcacccgggcgcggcgtcgcgggggccgagggaaggaccggaccctcccgaggtcgcggacccggccggctggggcgaggctggggtggcccctaccccgagctaagctggccgcgccgcatctcaccgtcgccggggcccgagcgctgcgcctggaccggcgccgagcgagggggccaagcggccggctggacccacagtccccgcgccataggcgggtcggggctttcagactcggctccagccctcaaacctggtagccttggaggtcagcttgagatgactgcgcttcctgcgcgcgttgtcctccccagaaacgctcaaaatggcaaagcggcgtccgtggccgccggaggcctgtgttctcccctgccgaacctcacgcgcggcccctccctcattttcttctggccaggctgccccctgccccttgggcgattctgctgcgtcccacggtcctggctgtgg

SEQ ID NO: 131548 - DNA, 327 bp, Homo sapiens; identical to SEQ ID NO: 100850
  misc_feature 1..327: note = chr9:140030248-140030575
  misc_feature 1..327: note = Hypo
  source 1..327: mol_type = genomic DNA

SEQ ID NO: 131549 - DNA, 103 bp, Homo sapiens; identical to SEQ ID NO: 100851
  misc_feature 1..103: note = chr9:140032848-140032951
  misc_feature 1..103: note = Hyper
  source 1..103: mol_type = genomic DNA

SEQ ID NO: 131550 - DNA, 903 bp, Homo sapiens
  misc_feature 1..903: note = chr9:140033279-140034182
  misc_feature 1..903: note = Hyper
  source 1..903: mol_type = genomic DNA
acatacaagcgggcacgacgcgttcggtcctattaaaaggcacgcaagggtgcgggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacgcgaacgcaggcgcacgctctggcgcgggaggcgcccccttcgcctccgtgttgggaagcgggggcggcgggaggggcaggagacgttggccccgctcgcgtttctgcagctgctgcagtcgccgcagcgtccggaccggaaccagcgccgtccgcggagccgccgccgccgccgccgggccctttccaagccgggcgctcggagctgtgcccggccccgcttcagcaccgcggacagcgccggccgcgtggggctgagccccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacc

SEQ ID NO: 131551 - DNA, 98 bp, Homo sapiens; identical to SEQ ID NO: 100855
  misc_feature 1..98: note = chr9:140041751-140041849
  misc_feature 1..98: note = Hypo
  source 1..98: mol_type = genomic DNA

SEQ ID NO: 131552 - DNA, 132 bp, Homo sapiens; identical to SEQ ID NO: 100856
  misc_feature 1..132: note = chr9:140043219-140043351
  misc_feature 1..132: note = Hypo
  source 1..132: mol_type = genomic DNA

SEQ ID NO: 131553 - DNA, 23 bp, Homo sapiens
  misc_feature 1..23: note = chr9:140046638-140046661
  misc_feature 1..23: note = Hypo
  source 1..23: mol_type = genomic DNA
tgagccaccgtgcccagccactt

SEQ ID NO: 131554 - DNA, 584 bp, Homo sapiens
  misc_feature 1..584: note = chr9:140050925-140051509
  misc_feature 1..584: note = Hyper
  source 1..584: mol_type = genomic DNA
ggtaagagccagcaacggaggcctgggaggctcctgggttctgggccgcagcgcctctgcgaggtctgcaggcttcgctctaggaggggatgggggctgggcaggtccctgctccagaggaggaggacctgggcctgcggagcgccgcggtgggagtgctggagtcctggcccgtcatccccgtctgccccacagcgaggacgatgctgccactgtataccgcgcagccgcgatgctgaacatgacgggctccgggtacgtgtggctggtcggcgagcgcgagatctcggggaacgccctgcgctacgccccagacggtgagtgctgggccttggcggggtccccgaacggggaggaccccacgggctctgagtcgcatgctcgcctaggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagaggtgggcggggcctccccgga

SEQ ID NO: 131555 - DNA, 62 bp, Homo sapiens; identical to SEQ ID NO: 100860
  misc_feature 1..62: note = chr9:140052371-140052433
  misc_feature 1..62: note = Hypo
  source 1..62: mol_type = genomic DNA

SEQ ID NO: 131556 - DNA, 30 bp, Homo sapiens; identical to SEQ ID NO: 100861
  misc_feature 1..30: note = chr9:140081822-140081852
  misc_feature 1..30: note = Hypo
  source 1..30: mol_type = genomic DNA

SEQ ID NO: 131557 - DNA, 30 bp, Homo sapiens; identical to SEQ ID NO: 100862
  misc_feature 1..30: note = chr9:140089410-140089440
  misc_feature 1..30: note = Hypo
  source 1..30: mol_type = genomic DNA

SEQ ID NO: 131558 - DNA, 30 bp, Homo sapiens; identical to SEQ ID NO: 100863
  misc_feature 1..30: note = chr9:140090122-140090152
  misc_feature 1..30: note = Hypo
  source 1..30: mol_type = genomic DNA

SEQ ID NO: 131559 - DNA, 143 bp, Homo sapiens; identical to SEQ ID NO: 100864
  misc_feature 1..143: note = chr9:140090372-140090515
  misc_feature 1..143: note = Hypo
  source 1..143: mol_type = genomic DNA

SEQ ID NO: 131560 - DNA, 627 bp, Homo sapiens; identical to SEQ ID NO: 100865
  misc_feature 1..627: note = chr9:140107109-140107736
  misc_feature 1..627: note = Hypo
  source 1..627: mol_type = genomic DNA

SEQ ID NO: 131561 - DNA, 423 bp, Homo sapiens; identical to SEQ ID NO: 100866
  misc_feature 1..423: note = chr9:140108038-140108461
  misc_feature 1..423: note = Hypo
  source 1..423: mol_type = genomic DNA

SEQ ID NO: 131562 - DNA, 30 bp, Homo sapiens; identical to SEQ ID NO: 42385
  misc_feature 1..30: note = chr9:140115123-140115153
  misc_feature 1..30: note = Hypo
  source 1..30: mol_type = genomic DNA

SEQ ID NO: 131563 - DNA, 186 bp, Homo sapiens; identical to SEQ ID NO: 100868
  misc_feature 1..186: note = chr9:140121048-140121234
  misc_feature 1..186: note = Hypo
  source 1..186: mol_type = genomic DNA

SEQ ID NO: 131564 - DNA, 551 bp, Homo sapiens; identical to SEQ ID NO: 100869
  misc_feature 1..551: note = chr9:140127636-140128187
  misc_feature 1..551: note = Hypo
  source 1..551: mol_type = genomic DNA

SEQ ID NO: 131565 - DNA, 104 bp, Homo sapiens; identical to SEQ ID NO: 100870
  misc_feature 1..104: note = chr9:140137230-140137334
  misc_feature 1..104: note = Hypo
  source 1..104: mol_type = genomic DNA

SEQ ID NO: 131566 - DNA, 120 bp, Homo sapiens; identical to SEQ ID NO: 100871
  misc_feature 1..120: note = chr9:140137634-140137754
  misc_feature 1..120: note = Hypo
  source 1..120: mol_type = genomic DNA

SEQ ID NO: 131567 - DNA, 37 bp, Homo sapiens; identical to SEQ ID NO: 100872
  misc_feature 1..37: note = chr9:140140229-140140266
  misc_feature 1..37: note = Hypo
  source 1..37: mol_type = genomic DNA

SEQ ID NO: 131568 - DNA, 89 bp, Homo sapiens; identical to SEQ ID NO: 100873
  misc_feature 1..89: note = chr9:140140759-140140848
  misc_feature 1..89: note = Hypo
  source 1..89: mol_type = genomic DNA

SEQ ID NO: 131569 - DNA, 124 bp, Homo sapiens; identical to SEQ ID NO: 100874
  misc_feature 1..124: note = chr9:140144101-140144225
  misc_feature 1..124: note = Hypo
  source 1..124: mol_type = genomic DNA

SEQ ID NO: 131570 - DNA, 123 bp, Homo sapiens; identical to SEQ ID NO: 100875
  misc_feature 1..123: note = chr9:140147052-140147175
  misc_feature 1..123: note = Hypo
  source 1..123: mol_type = genomic DNA

SEQ ID NO: 131571 - DNA, 71 bp, Homo sapiens; identical to SEQ ID NO: 100876
  misc_feature 1..71: note = chr9:140167020-140167091
  misc_feature 1..71: note = Hypo
  source 1..71: mol_type = genomic DNA

SEQ ID NO: 131572 - DNA, 30 bp, Homo sapiens; identical to SEQ ID NO: 100877
  misc_feature 1..30: note = chr9:140167383-140167413
  misc_feature 1..30: note = Hypo
  source 1..30: mol_type = genomic DNA

SEQ ID NO: 131573 - DNA, 30 bp, Homo sapiens; identical to SEQ ID NO: 100878
  misc_feature 1..30: note = chr9:140196166-140196196
  misc_feature 1..30: note = Hyper
  source 1..30: mol_type = genomic DNA

SEQ ID NO: 131574 - DNA, 109 bp, Homo sapiens; identical to SEQ ID NO: 100879
  misc_feature 1..109: note = chr9:140198590-140198699
  misc_feature 1..109: note = Hypo
  source 1..109: mol_type = genomic DNA

SEQ ID NO: 131575 - DNA, 193 bp, Homo sapiens; identical to SEQ ID NO: 100880
  misc_feature 1..193: note = chr9:140205428-140205621
  misc_feature 1..193: note = Hypo
  source 1..193: mol_type = genomic DNA

SEQ ID NO: 131576 - DNA, 38 bp, Homo sapiens; identical to SEQ ID NO: 100881
  misc_feature 1..38: note = chr9:140208526-140208564
  misc_feature 1..38: note = Hypo
  source 1..38: mol_type = genomic DNA

SEQ ID NO: 131577 - DNA, 60 bp, Homo sapiens; identical to SEQ ID NO: 100882
  misc_feature 1..60: note = chr9:140211623-140211683
  misc_feature 1..60: note = Hypo
  source 1..60: mol_type = genomic DNA

SEQ ID NO: 131578 - DNA, 30 bp, Homo sapiens; identical to SEQ ID NO: 100883
  misc_feature 1..30: note = chr9:140216230-140216260
  misc_feature 1..30: note = Hypo
  source 1..30: mol_type = genomic DNA

SEQ ID NO: 131579 - DNA, 95 bp, Homo sapiens; identical to SEQ ID NO: 100884
  misc_feature 1..95: note = chr9:140243648-140243743
  misc_feature 1..95: note = Hypo
  source 1..95: mol_type = genomic DNA

SEQ ID NO: 131580 - DNA, 369 bp, Homo sapiens; identical to SEQ ID NO: 100885
  misc_feature 1..369: note = chr9:140245629-140245998
  misc_feature 1..369: note = Hypo
  source 1..369: mol_type = genomic DNA

SEQ ID NO: 131581 - DNA, 30 bp, Homo sapiens; identical to SEQ ID NO: 100886
  misc_feature 1..30: note = chr9:140246519-140246549
  misc_feature 1..30: note = Hypo
  source 1..30: mol_type = genomic DNA

SEQ ID NO: 131582 - DNA, 168 bp, Homo sapiens; identical to SEQ ID NO: 100887
  misc_feature 1..168: note = chr9:140265734-140265902
  misc_feature 1..168: note = Hypo
  source 1..168: mol_type = genomic DNA

SEQ ID NO: 131583 - DNA, 186 bp, Homo sapiens; identical to SEQ ID NO: 100888
  misc_feature 1..186: note = chr9:140266430-140266616
  misc_feature 1..186: note = Hypo
  source 1..186: mol_type = genomic DNA

SEQ ID NO: 131584 - DNA, 73 bp, Homo sapiens; identical to SEQ ID NO: 100889
  misc_feature 1..73: note = chr9:140267262-140267335
  misc_feature 1..73: note = Hypo
  source 1..73: mol_type = genomic DNA

SEQ ID NO: 131585 - DNA, 30 bp, Homo sapiens; identical to SEQ ID NO: 100890
  misc_feature 1..30: note = chr9:140267796-140267826
  misc_feature 1..30: note = Hypo
  source 1..30: mol_type = genomic DNA

SEQ ID NO: 131586 - DNA, 198 bp, Homo sapiens; identical to SEQ ID NO: 100891
  misc_feature 1..198: note = chr9:140274064-140274262
  misc_feature 1..198: note = Hypo
  source 1..198: mol_type = genomic DNA

SEQ ID NO: 131587 - DNA, 46 bp, Homo sapiens; identical to SEQ ID NO: 100892
  misc_feature 1..46: note = chr9:140274616-140274662
  misc_feature 1..46: note = Hypo
  source 1..46: mol_type = genomic DNA

SEQ ID NO: 131588 - DNA, 182 bp, Homo sapiens; identical to SEQ ID NO: 100893
  misc_feature 1..182: note = chr9:140325463-140325645
  misc_feature 1..182: note = Hypo
  source 1..182: mol_type = genomic DNA

SEQ ID NO: 131589 - DNA, 30 bp, Homo sapiens; identical to SEQ ID NO: 42401
  misc_feature 1..30: note = chr9:140327964-140327994
  misc_feature 1..30: note = Hypo
  source 1..30: mol_type = genomic DNA

SEQ ID NO: 131590 - DNA, 646 bp, Homo sapiens; identical to SEQ ID NO: 100895
  misc_feature 1..646: note = chr9:140332500-140333146
  misc_feature 1..646: note = Hypo
  source 1..646: mol_type = genomic DNA

SEQ ID NO: 131591 - DNA, 48 bp, Homo sapiens; identical to SEQ ID NO: 42404
  misc_feature 1..48: note = chr9:140352105-140352153
  misc_feature 1..48: note = Hypo
  source 1..48: mol_type = genomic DNA

SEQ ID NO: 131592 - DNA, 36 bp, Homo sapiens; identical to SEQ ID NO: 100897
  misc_feature 1..36: note = chr9:140352383-140352419
  misc_feature 1..36: note = Hypo
  source 1..36: mol_type = genomic DNA

SEQ ID NO: 131593 - DNA, 30 bp, Homo sapiens; identical to SEQ ID NO: 100898
  misc_feature 1..30: note = chr9:140357584-140357614
  misc_feature 1..30: note = Hypo
  source 1..30: mol_type = genomic DNA

SEQ ID NO: 131594 - DNA, 30 bp, Homo sapiens; identical to SEQ ID NO: 100899
  misc_feature 1..30: note = chr9:140379933-140379963
  misc_feature 1..30: note = Hypo
  source 1..30: mol_type = genomic DNA

SEQ ID NO: 131595 - DNA, 68 bp, Homo sapiens; identical to SEQ ID NO: 42405
  misc_feature 1..68: note = chr9:140382557-140382625
  misc_feature 1..68: note = Hypo
  source 1..68: mol_type = genomic DNA

SEQ ID NO: 131596 - DNA, 30 bp, Homo sapiens; identical to SEQ ID NO: 100901
  misc_feature 1..30: note = chr9:140388971-140389001
  misc_feature 1..30: note = Hypo
  source 1..30: mol_type = genomic DNA

SEQ ID NO: 131597 - DNA, 214 bp, Homo sapiens; identical to SEQ ID NO: 100902
  misc_feature 1..214: note = chr9:140389309-140389523
  misc_feature 1..214: note = Hypo
  source 1..214: mol_type = genomic DNA

SEQ ID NO: 131598 - DNA, 481 bp, Homo sapiens; identical to SEQ ID NO: 100903
  misc_feature 1..481: note = chr9:140392377-140392858
  misc_feature 1..481: note = Hypo
  source 1..481: mol_type = genomic DNA

SEQ ID NO: 131599 - DNA, 88 bp, Homo sapiens; identical to SEQ ID NO: 100904
  misc_feature 1..88: note = chr9:140395491-140395579
  misc_feature 1..88: note = Hypo
  source 1..88: mol_type = genomic DNA

SEQ ID NO: 131600 - DNA, 182 bp, Homo sapiens; identical to SEQ ID NO: 100905
  misc_feature 1..182: note = chr9:140396560-140396742
  misc_feature 1..182: note = Hypo
  source 1..182: mol_type = genomic DNA

SEQ ID NO: 131601 - DNA, 221 bp, Homo sapiens; identical to SEQ ID NO: 100906
  misc_feature 1..221: note = chr9:140396982-140397203
  misc_feature 1..221: note = Hypo
  source 1..221: mol_type = genomic DNA

SEQ ID NO: 131602 - DNA, 261 bp, Homo sapiens; identical to SEQ ID NO: 100907
  misc_feature 1..261: note = chr9:140400208-140400469
  misc_feature 1..261: note = Hypo
  source 1..261: mol_type = genomic DNA

SEQ ID NO: 131603 - DNA, 30 bp, Homo sapiens; identical to SEQ ID NO: 100908
  misc_feature 1..30: note = chr9:140400875-140400905
  misc_feature 1..30: note = Hypo
  source 1..30: mol_type = genomic DNA

SEQ ID NO: 131604 - DNA, 169 bp, Homo sapiens; identical to SEQ ID NO: 100909
  misc_feature 1..169: note = chr9:140401421-140401590
  misc_feature 1..169: note = Hypo
  source 1..169: mol_type = genomic DNA

SEQ ID NO: 131605 - DNA, 27 bp, Homo sapiens
  misc_feature 1..27: note = chr9:140498381-140498408
  misc_feature 1..27: note = Hypo
  source 1..27: mol_type = genomic DNA
agccaccgcgcccggtgaaacaccttc

SEQ ID NO: 131606 - DNA, 127 bp, Homo sapiens; identical to SEQ ID NO: 100911
  misc_feature 1..127: note = chr9:140507292-140507419
  misc_feature 1..127: note = Hypo
  source 1..127: mol_type = genomic DNA

SEQ ID NO: 131607 - DNA, 74 bp, Homo sapiens; identical to SEQ ID NO: 100912
  misc_feature 1..74: note = chr9:140508476-140508550
  misc_feature 1..74: note = Hypo
  source 1..74: mol_type = genomic DNA

SEQ ID NO: 131608 - DNA, 23 bp, Homo sapiens
  misc_feature 1..23: note = chr9:140511850-140511873
  misc_feature 1..23: note = Hypo
  source 1..23: mol_type = genomic DNA
accgcacccggcccagtcaacaa

SEQ ID NO: 131609 - DNA, 174 bp, Homo sapiens; identical to SEQ ID NO: 100914
  misc_feature 1..174: note = chr9:140512180-140512354
  misc_feature 1..174: note = Hypo
  source 1..174: mol_type = genomic DNA

SEQ ID NO: 131610 - DNA, 19 bp, Homo sapiens
  misc_feature 1..19: note = chr9:140539579-140539598
  misc_feature 1..19: note = Hypo
  source 1..19: mol_type = genomic DNA
ctcccgaagtgctgggatt

SEQ ID NO: 131611 - DNA, 30 bp, Homo sapiens; identical to SEQ ID NO: 100916
  misc_feature 1..30: note = chr9:140582852-140582882
  misc_feature 1..30: note = Hypo
  source 1..30: mol_type = genomic DNA

SEQ ID NO: 131612 - DNA, 48 bp, Homo sapiens; identical to SEQ ID NO: 100917
  misc_feature 1..48: note = chr9:140615444-140615492
  misc_feature 1..48: note = Hypo
  source 1..48: mol_type = genomic DNA

SEQ ID NO: 131613 - DNA, 285 bp, Homo sapiens; identical to SEQ ID NO: 100918
  misc_feature 1..285: note = chr9:140657710-140657995
  misc_feature 1..285: note = Hypo
  source 1..285: mol_type = genomic DNA

SEQ ID NO: 131614 - DNA, 30 bp, Homo sapiens; identical to SEQ ID NO: 100919
  misc_feature 1..30: note = chr9:140658538-140658568
  misc_feature 1..30: note = Hypo
  source 1..30: mol_type = genomic DNA

SEQ ID NO: 131615 - DNA, 100 bp, Homo sapiens; identical to SEQ ID NO: 100920
  misc_feature 1..100: note = chr9:140664560-140664660
  misc_feature 1..100: note = Hypo
  source 1..100: mol_type = genomic DNA

SEQ ID NO: 131616 - DNA, 161 bp, Homo sapiens; identical to SEQ ID NO: 100921
  misc_feature 1..161: note = chr9:140665866-140666027
  misc_feature 1..161: note = Hypo
  source 1..161: mol_type = genomic DNA

SEQ ID NO: 131617 - DNA, 45 bp, Homo sapiens; identical to SEQ ID NO: 15313
  misc_feature 1..45: note = chr9:140680320-140680365
  misc_feature 1..45: note = Hypo
  source 1..45: mol_type = genomic DNA

SEQ ID NO: 131618 - DNA, 127 bp, Homo sapiens; identical to SEQ ID NO: 100923
  misc_feature 1..127: note = chr9:140682795-140682922
  misc_feature 1..127: note = Hypo
  source 1..127: mol_type = genomic DNA

SEQ ID NO: 131619 - DNA, 30 bp, Homo sapiens; identical to SEQ ID NO: 42421
  misc_feature 1..30: note = chr9:140693933-140693963
  misc_feature 1..30: note = Hypo
  source 1..30: mol_type = genomic DNA

SEQ ID NO: 131620 - DNA, 390 bp, Homo sapiens; identical to SEQ ID NO: 100925
  misc_feature 1..390: note = chr9:140707510-140707900
  misc_feature 1..390: note = Hypo
  source 1..390: mol_type = genomic DNA

SEQ ID NO: 131621 - DNA, 79 bp, Homo sapiens; identical to SEQ ID NO: 100926
  misc_feature 1..79: note = chr9:140708692-140708771
  misc_feature 1..79: note = Hypo
  source 1..79: mol_type = genomic DNA

SEQ ID NO: 131622 - DNA, 188 bp, Homo sapiens; identical to SEQ ID NO: 100927
  misc_feature 1..188: note = chr9:140708986-140709174
  misc_feature 1..188: note = Hypo
  source 1..188: mol_type = genomic DNA

SEQ ID NO: 131623 - DNA, 30 bp, Homo sapiens; identical to SEQ ID NO: 100928
  misc_feature 1..30: note = chr9:140723495-140723525
  misc_feature 1..30: note = Hypo
  source 1..30: mol_type = genomic DNA

SEQ ID NO: 131624 - DNA, 405 bp, Homo sapiens; identical to SEQ ID NO: 100929
  misc_feature 1..405: note = chr9:140727525-140727930
  misc_feature 1..405: note = Hypo
  source 1..405: mol_type = genomic DNA

SEQ ID NO: 131625 - DNA, 97 bp, Homo sapiens; identical to SEQ ID NO: 100930
  misc_feature 1..97: note = chr9:140770013-140770110
  misc_feature 1..97: note = Hypo
  source 1..97: mol_type = genomic DNA

SEQ ID NO: 131626 - DNA, 278 bp, Homo sapiens; identical to SEQ ID NO: 100931
  misc_feature 1..278: note = chr9:140772069-140772347
  misc_feature 1..278: note = Hyper
  source 1..278: mol_type = genomic DNA

SEQ ID NO: 131627 - DNA, 958 bp, Homo sapiens
  misc_feature 1..958: note = chr9:140772557-140773515
  misc_feature 1..958: note = Hyper
  source 1..958: mol_type = genomic DNA
tgtacaaccccatcccggtcaagcagaactgcttcaccgtcaaccgctcgctcttcgtcttcagcgaggacaacgtcgtccgcaaatacgcgaagcgcatcaccgagtggccatatcctgccgggcggggccgggcggggccgggcggggaccggggtgggggccggggccggggccatcttcccggtggccgggagggcgcgacctggggaggcgtcgggagacgggcgaggggggtacggagcgccccagggcccctcggagcggcgggtgcgggagcatttccgtgagtgcggcgggcgcggggcggagcccctctgctccggactcgtccctccgcacgccgggtcctggggatcctggtcggtgcacagtgcgcggctagcctggagggcaccgagggcgaagccgcgtccgtgcaggtgcgagcgctgtggggacgcggccgtgcgcgcgcctggctgcaggtgcctgcgtgtgcgggctgagctggagcctggcgctgcgcgtgcgtgcgctcgcgatgcgggctacatgcatgttcacgtgcctgtgtaggtacatgtggctgcgtgtctggagggagcagcgtgcgcctgcgcggggtctccctccagcctcgcctgggggcgctcggccccctcccctcggggccctggagtcgggcggagccgggccggaggcgctgtccgcggtgctgacggccgcccgggtgtgccgaggggctggcggcccagactgcggaggccccgcctcgcggccgcccctagggatgggggcagggagtgagggagaccaggccgcttccgccaggagaggggctccggacccagttgtctcagcccctccggagacggcctagcggtggctgctgcactgggctctgctggcgtcggcctcgtgtttccctccgtgcggcgtctgccggccagtccttaactcacgcactccattcgag

SEQ ID NO: 131628 - DNA, 18 bp, Homo sapiens
  misc_feature 1..18: note = chr9:140793805-140793823
  misc_feature 1..18: note = Hypo
  source 1..18: mol_type = genomic DNA
aagcgctgggattgggat

SEQ ID NO: 131629 - DNA, 86 bp, Homo sapiens; identical to SEQ ID NO: 100935
  misc_feature 1..86: note = chr9:140969254-140969340
  misc_feature 1..86: note = Hypo
  source 1..86: mol_type = genomic DNA

SEQ ID NO: 131630 - DNA, 177 bp, Homo sapiens; identical to SEQ ID NO: 42427
  misc_feature 1..177: note = chr9:141022582-141022759
  misc_feature 1..177: note = Hypo
  source 1..177: mol_type = genomic DNA

SEQ ID NO: 131631 - DNA, 107 bp, Homo sapiens; identical to SEQ ID NO: 100937
  misc_feature 1..107: note = chr9:141044732-141044839
  misc_feature 1..107: note = Hyper
  source 1..107: mol_type = genomic DNA

SEQ ID NO: 131632 - DNA, 147 bp, Homo sapiens; identical to SEQ ID NO: 101458
  misc_feature 1..147: note = chrX:2742585-2742732
  misc_feature 1..147: note = Hypo
  source 1..147: mol_type = genomic DNA

SEQ ID NO: 131633 - DNA, 83 bp, Homo sapiens; identical to SEQ ID NO: 101459
  misc_feature 1..83: note = chrX:2746913-2746996
  misc_feature 1..83: note = Hyper
  source 1..83: mol_type = genomic DNA

SEQ ID NO: 131634 - DNA, 235 bp, Homo sapiens; identical to SEQ ID NO: 101460
  misc_feature 1..235: note = chrX:2747708-2747943
  misc_feature 1..235: note = Hyper
  source 1..235: mol_type = genomic DNA

SEQ ID NO: 131635 - DNA, 100 bp, Homo sapiens; identical to SEQ ID NO: 101461
  misc_feature 1..100: note = chrX:2825711-2825811
  misc_feature 1..100: note = Hypo
  source 1..100: mol_type = genomic DNA

SEQ ID NO: 131636 - DNA, 30 bp, Homo sapiens; identical to SEQ ID NO: 101462
  misc_feature 1..30: note = chrX:2835934-2835964
  misc_feature 1..30: note = Hypo
  source 1..30: mol_type = genomic DNA

SEQ ID NO: 131637 - DNA, 148 bp, Homo sapiens; identical to SEQ ID NO: 101463
  misc_feature 1..148: note = chrX:2836217-2836365
  misc_feature 1..148: note = Hypo
  source 1..148: mol_type = genomic DNA

SEQ ID NO: 131638 - DNA, 158 bp, Homo sapiens; identical to SEQ ID NO: 38629
  misc_feature 1..158: note = chrX:2846239-2846397
  misc_feature 1..158: note = Hyper
  source 1..158: mol_type = genomic DNA

SEQ ID NO: 131639 - DNA, 49 bp, Homo sapiens; identical to SEQ ID NO: 101465
  misc_feature 1..49: note = chrX:2846807-2846856
  misc_feature 1..49: note = Hyper
  source 1..49: mol_type = genomic DNA

SEQ ID NO: 131640 - DNA, 121 bp, Homo sapiens; identical to SEQ ID NO: 101466
  misc_feature 1..121: note = chrX:2847075-2847196
  misc_feature 1..121: note = Hyper
  source 1..121: mol_type = genomic DNA

SEQ ID NO: 131641 - DNA, 159 bp, Homo sapiens; identical to SEQ ID NO: 101467
  misc_feature 1..159: note = chrX:2931173-2931332
  misc_feature 1..159: note = Hypo
  source 1..159: mol_type = genomic DNA

SEQ ID NO: 131642 - DNA, 30 bp, Homo sapiens; identical to SEQ ID NO: 101468
  misc_feature 1..30: note = chrX:2933263-2933293
  misc_feature 1..30: note = Hypo
  source 1..30: mol_type = genomic DNA

SEQ ID NO: 131643 - DNA, 100 bp, Homo sapiens; identical to SEQ ID NO: 101470
  misc_feature 1..100: note = chrX:2945321-2945421
  misc_feature 1..100: note = Hypo
  source 1..100: mol_type = genomic DNA

SEQ ID NO: 131644 - DNA, 39 bp, Homo sapiens; identical to SEQ ID NO: 101472
  misc_feature 1..39: note = chrX:3229228-3229267
  misc_feature 1..39: note = Hypo
  source 1..39: mol_type = genomic DNA

SEQ ID NO: 131645 - DNA, 814 bp, Homo sapiens
  misc_feature 1..814: note = chrX:3263355-3264169
  misc_feature 1..814: note = Hyper
  source 1..814: mol_type = genomic DNA
ggctccgcctctgggcgctggaacaaaccggctcctgcagctctgcaaaagtcctcggagttttctctctcgccagagcccgggctttccccgcccctgcctgcgcgcctgacctcggcgctgggctggttccaagggcagccgcgccagtccccagcgtcctgtgcctgcgggcggacttggcccgggcgttccataggactcttcagccccaactccctgtccggcctcccaccccggcaccaacctcccgggagacccaggaaactcgcccccagacaaccctaatcccggggactcggggtcgggtctctccgccgcggagaaagcggcctggcgccagctaggccgccagagacggtctgcgaaccccgccgggaagcaggggtgggggcgtgaggccgtctgctttcgtcttggccctgggcagacaacctggagtggccgggcgggcagccctgagcccctggccggcttccagagtccgctgggtcgcgtcgagctggctgcgggatgaattacgagctttcccggaacgcggctggggtggccctgcgagtccccgccgcccgggactcggacaccaaaccccttttgtctgcgtgatgactgtcccggtttttttgcatggctcggatcactctaggcgttgggctgtcccctttccagggaaagcctgggtaagagtaggaggaaagaggcggggaaggagagggggaagagaggagggagaggagacttgaagtagccacagcctgagcaacttggaaagaggctcctcaagcgtcctttcccccaccgattgcaagagcag

SEQ ID NO: 131646 - DNA, 596 bp, Homo sapiens
  misc_feature 1..596: note = chrX:3264627-3265223
  misc_feature 1..596: note = Hyper
  source 1..596: mol_type = genomic DNA
cggccgggagtttgccggggccatgcccttcccggggccgggggtgaggcagctcggcttcccagcgcggcacagcaagccggcgcccttttattcccggcgctgcgaggcttccccaagtccacgcctcggcacacccccaccctgccccaccccggggagacggggcgcgggcccgagccaagggaccctggccgcgccgctctgcgctcagccttcctctcgcgtcttcattgcgcctgggcccgggtgggcatgcctcgcccactccagctgcaagaaccgcaggcggctcggggaaggagggctctttgtcagagagaagtccaggaccccaggagggaagggcgagatgcagggagcgcggtgggagccgcagtagagtccgcgcttggagagcgcctaagcagcgctgggaacgtttccgttcctttcaggagagagagaaggagcagggtttgcgcttctccgggccagacggtgttttctcggcagctcttcccagaccgtgtgcaagcaggagcgggctggccccgccggcatcccactagctgcaggcagggctgcaacgtgagagccgccgccacgccctcccg

SEQ ID NO: 131647 - DNA, 102 bp, Homo sapiens; identical to SEQ ID NO: 101479
  misc_feature 1..102: note = chrX:3478175-3478277
  misc_feature 1..102: note = Hypo
  source 1..102: mol_type = genomic DNA

SEQ ID NO: 131648 - DNA, 33 bp, Homo sapiens; identical to SEQ ID NO: 101480
  misc_feature 1..33: note = chrX:3630804-3630837
  misc_feature 1..33: note = Hyper
  source 1..33: mol_type = genomic DNA

SEQ ID NO: 131649 - DNA, 40 bp, Homo sapiens; identical to SEQ ID NO: 101481
  misc_feature 1..40: note = chrX:3694581-3694621
  misc_feature 1..40: note = Hypo
  source 1..40: mol_type = genomic DNA

SEQ ID NO: 131650 - DNA, 140 bp, Homo sapiens; identical to SEQ ID NO: 101482
  misc_feature 1..140: note = chrX:3746502-3746642
  misc_feature 1..140: note = Hypo
  source 1..140: mol_type = genomic DNA

SEQ ID NO: 131651 - DNA, 30 bp, Homo sapiens; identical to SEQ ID NO: 101495
  misc_feature 1..30: note = chrX:4335009-4335039
  misc_feature 1..30: note = Hypo
  source 1..30: mol_type = genomic DNA

SEQ ID NO: 131652 - DNA, 32 bp, Homo sapiens; identical to SEQ ID NO: 101502
  misc_feature 1..32: note = chrX:4606598-4606630
  misc_feature 1..32: note = Hypo
  source 1..32: mol_type = genomic DNA

SEQ ID NO: 131653 - DNA, 31 bp, Homo sapiens; identical to SEQ ID NO: 101503
  misc_feature 1..31: note = chrX:4606870-4606901
  misc_feature 1..31: note = Hypo
  source 1..31: mol_type = genomic DNA

SEQ ID NO: 131654 - DNA, 30 bp, Homo sapiens; identical to SEQ ID NO: 101504
  misc_feature 1..30: note = chrX:4636880-4636910
  misc_feature 1..30: note = Hypo
  source 1..30: mol_type = genomic DNA

SEQ ID NO: 131655 - DNA, 196 bp, Homo sapiens; identical to SEQ ID NO: 101505
  misc_feature 1..196: note = chrX:4691958-4692154
  misc_feature 1..196: note = Hypo
  source 1..196: mol_type = genomic DNA

SEQ ID NO: 131656 - DNA, 30 bp, Homo sapiens; identical to SEQ ID NO: 46884
  misc_feature 1..30: note = chrX:5757324-5757354
  misc_feature 1..30: note = Hypo
  source 1..30: mol_type = genomic DNA

SEQ ID NO: 131657 - DNA, 94 bp, Homo sapiens; identical to SEQ ID NO: 101512
  misc_feature 1..94: note = chrX:6143621-6143715
  misc_feature 1..94: note = Hyper
  source 1..94: mol_type = genomic DNA

SEQ ID NO: 131658 - DNA, 514 bp, Homo sapiens; identical to SEQ ID NO: 101513
  misc_feature 1..514: note = chrX:6143775-6144289
  misc_feature 1..514: note = Hyper
  source 1..514: mol_type = genomic DNA

SEQ ID NO: 131659 - DNA, 937 bp, Homo sapiens
  misc_feature 1..937: note = chrX:6144913-6145850
  misc_feature 1..937: note = Hyper
  source 1..937: mol_type = genomic DNA
tccctacctcatccccgctcgcgcttccgcaggtcaggccacgcgggtgccagcgcgggctgtgggcgccccagccgcggccttggggaggggtcaggactgaagttcactctctctctgcgtggtctcgaagcccctcgcccaccccgcactgtctcctccgccgccggctgcgcgcttggcggatcttctccatcagttctgcccactggagtgggaaggggctgagccgagccgcgcgggaattgggaggcggggaagcggggaggcgggggaagagacgagatgaaatcggcccgggacagcagagaggcttgggatgggatggaagggaagagggggtggcggttgcgttttccagggctgtagaggtggtgcgcctattggaaccgactcctcagcctcctcccccgtccccacctcggggactggcggaccgtgcgccccgcaggcttaacactccccccgacaccctcgctccgagaaggggtgttctcagtgggcaccgactagggctccagatcccccgagacccagaccagggctccggtagtctgtcctcgcagcttccaacttttccgctccttcggaaaagcgggcagttcagagatggttcccagggcggcagctgcaagcccccccgcgcccccctcaaaggttcagactacactcaaaggctccgaaagaagcaaaaccaccagctctaccctccttctgcggcttgcctcacccttcccacccgcctcgaaacccacacacacgggaaaggggtgcatggagcccgctccccggtttacagaagcagcccggagctaccgtcatttcatcttcacgcggggtctccagcgcgcctggatcgttccctagccaagccaagccaggtctaatcaatcacgtgcgttatttcgtgcatcacccaagccgtcatcttatccga

SEQ ID NO: 131660 - DNA, 178 bp, Homo sapiens; identical to SEQ ID NO: 101522
  misc_feature 1..178: note = chrX:7895411-7895589
  misc_feature 1..178: note = Hyper
  source 1..178: mol_type = genomic DNA

SEQ ID NO: 131661 - DNA, 719 bp, Homo sapiens
  misc_feature 1..719: note = chrX:8698504-8699223
  misc_feature 1..719: note = Hyper
  source 1..719: mol_type = genomic DNA
gccagcttcaccagccggttcaagatcatccccgagggtaaggggaatcacttccacattccacccttattaatatggcctcctctggcagcttaattcccagggcctctagggggacccccccccccaccccttgacccagctctggcaggaggggcgcccagtttaagagccaagggtttggcttccagttcccgcccagccaggggaacccctccccccagcccccatttctccttttggtccctccagagtttccctgaagcgagaaattgggaacttggaacaggtgggcacctagggatagaggcgagaagaagaaggagagaaggatgagagaagagaaaaataagcggaggatttcagagctcgcacgctcgacagggctggtacaggcagcagctgcactcgctcgcgctgagtccggaacctgctctcgtgcgcccacccgcacccggagcctcgcgcaagtcccgcgggggtccgcgccacagggcagagtcccggcaacccgctggagccaagcgcgcggctcccggagcctcccacacaagcgcgcgcgcacacacacatactccccaccctcaggctgaaagaacctacgttcggggtttgggggacggttcccccgggactcgttgaggagtatccgaatacggccccgccaaatcccctgtccccggcacttcttccctgacgctctacgctagtccagggca

SEQ ID NO: 131662 - DNA, 314 bp, Homo sapiens; identical to SEQ ID NO: 101525
  misc_feature 1..314: note = chrX:8699436-8699750
  misc_feature 1..314: note = Hyper
  source 1..314: mol_type = genomic DNA

SEQ ID NO: 131663 - DNA, 422 bp, Homo sapiens; identical to SEQ ID NO: 101526
  misc_feature 1..422: note = chrX:8700038-8700460
  misc_feature 1..422: note = Hyper
  source 1..422: mol_type = genomic DNA

SEQ ID NO: 131664 - DNA, 45 bp, Homo sapiens; identical to SEQ ID NO: 101531
  misc_feature 1..45: note = chrX:9433426-9433471
  misc_feature 1..45: note = Hyper
  source 1..45: mol_type = genomic DNA

SEQ ID NO: 131665 - DNA, 126 bp, Homo sapiens; identical to SEQ ID NO: 101532
  misc_feature 1..126: note = chrX:9433712-9433838
  misc_feature 1..126: note = Hyper
  source 1..126: mol_type = genomic DNA

SEQ ID NO: 131666 - DNA, 30 bp, Homo sapiens; identical to SEQ ID NO: 46885
  misc_feature 1..30: note = chrX:11773720-11773750
  misc_feature 1..30: note = Hypo
  source 1..30: mol_type = genomic DNA

SEQ ID NO: 131667 - DNA, 36 bp, Homo sapiens; identical to SEQ ID NO: 101427
  misc_feature 1..36: note = chrX:12157151-12157187
  misc_feature 1..36: note = Hyper
  source 1..36: mol_type = genomic DNA

SEQ ID NO: 131668 - DNA, 30 bp, Homo sapiens; identical to SEQ ID NO: 101429
  misc_feature 1..30: note = chrX:12734830-12734860
  misc_feature 1..30: note = Hypo
  source 1..30: mol_type = genomic DNA

SEQ ID NO: 131669 - DNA, 181 bp, Homo sapiens; identical to SEQ ID NO: 101431
  misc_feature 1..181: note = chrX:13707253-13707434
  misc_feature 1..181: note = Hyper
  source 1..181: mol_type = genomic DNA

SEQ ID NO: 131670 - DNA, 30 bp, Homo sapiens; identical to SEQ ID NO: 101432
  misc_feature 1..30: note = chrX:13740786-13740816
  misc_feature 1..30: note = Hypo
  source 1..30: mol_type = genomic DNA

SEQ ID NO: 131671 - DNA, 1260 bp, Homo sapiens; identical to SEQ ID NO: 101433
  misc_feature 1..1260: note = chrX:13955858-13957118
  misc_feature 1..1260: note = Hyper
  source 1..1260: mol_type = genomic DNA

SEQ ID NO: 131672 - DNA, 151 bp, Homo sapiens; identical to SEQ ID NO: 101435
  misc_feature 1..151: note = chrX:14048060-14048211
  misc_feature 1..151: note = Hyper
  source 1..151: mol_type = genomic DNA

SEQ ID NO: 131673 - DNA, 102 bp, Homo sapiens; identical to SEQ ID NO: 101440
  misc_feature 1..102: note = chrX:15511442-15511544
  misc_feature 1..102: note = Hyper
  source 1..102: mol_type = genomic DNA

SEQ ID NO: 131674 - DNA, 262 bp, Homo sapiens; identical to SEQ ID NO: 101441
  misc_feature 1..262: note = chrX:15756104-15756366
  misc_feature 1..262: note = Hyper
  source 1..262: mol_type = genomic DNA

SEQ ID NO: 131675 - DNA, 30 bp, Homo sapiens; identical to SEQ ID NO: 101442
  misc_feature 1..30: note = chrX:16702919-16702949
  misc_feature 1..30: note = Hypo
  source 1..30: mol_type = genomic DNA

SEQ ID NO: 131676 - DNA, 718 bp, Homo sapiens
  misc_feature 1..718: note = chrX:16729910-16730628
  misc_feature 1..718: note = Hyper
  source 1..718: mol_type = genomic DNA
attctgtagcagcagcgtagttcggcactatgcgccctaaccatctagtacggggaaaacgcgggggtcgttgtttaaggggtgcactgggaccggggagaggacagaaaggccatgttaccggcgctgatcaccagcctcgcagacccccgctcggggcttcacttccgccaacgccatctcagggctctcctggctcccgagggccgggagaagtggggatccgggtgcgggcgctggcgcgggcggaggcgggaagaagcgcgtcccggggacgcgcgggacaggctccaaccgcactgggcacgggccagcgttccccagtccccgcgccacacccggcagccgaggtctgcgagcgcggggctggcggccggacccgactcagcgctgggcagggagccggcgccatcagagagcggacaaaggagcccggccccacaagtgcaccggggctgggggtgcagggcggagaggccctggggacgagggatggcccgggcgccgaggccctgggggtctgggacaggcccagaagggaagttacctgcgcggtggtggtagcaccggggagggtggccggtgggcacggcgggctccaccccgcggctggcctggcgctcacctgtcgggctggggaaggggtcgctgccggggctgtccaaagccgcccccgggatcttcccaccgcccacacgggcctcggggtgcgcggcgc

SEQ ID NO: 131677 - DNA, 50 bp, Homo sapiens; identical to SEQ ID NO: 101445
  misc_feature 1..50: note = chrX:16730852-16730902
  misc_feature 1..50: note = Hyper
  source 1..50: mol_type = genomic DNA

SEQ ID NO: 131678 - DNA, 395 bp, Homo sapiens; identical to SEQ ID NO: 101446
  misc_feature 1..395: note = chrX:16887830-16888225
  misc_feature 1..395: note = Hyper
  source 1..395: mol_type = genomic DNA

SEQ ID NO: 131679 - DNA, 112 bp, Homo sapiens; identical to SEQ ID NO: 101447
  misc_feature 1..112: note = chrX:16888552-16888664
  misc_feature 1..112: note = Hyper
  source 1..112: mol_type = genomic DNA

SEQ ID NO: 131680 - DNA, 30 bp, Homo sapiens; identical to SEQ ID NO: 101448
  misc_feature 1..30: note = chrX:19353762-19353792
  misc_feature 1..30: note = Hypo
  source 1..30: mol_type = genomic DNA

SEQ ID NO: 131681 - DNA, 20 bp, Homo sapiens
  misc_feature 1..20: note = chrX:19435187-19435207
  misc_feature 1..20: note = Hypo
  source 1..20: mol_type = genomic DNA
caagatggctgaatacgaac

SEQ ID NO: 131682 - DNA, 35 bp, Homo sapiens; identical to SEQ ID NO: 101450
  misc_feature 1..35: note = chrX:20160936-20160971
  misc_feature 1..35: note = Hypo
  source 1..35: mol_type = genomic DNA

SEQ ID NO: 131683 - DNA, 42 bp, Homo sapiens; identical to SEQ ID NO: 101451
  misc_feature 1..42: note = chrX:22973409-22973451
  misc_feature 1..42: note = Hypo
  source 1..42: mol_type = genomic DNA

SEQ ID NO: 131684 - DNA, 39 bp, Homo sapiens; identical to SEQ ID NO: 101452
  misc_feature 1..39: note = chrX:23217730-23217769
  misc_feature 1..39: note = Hypo
  source 1..39: mol_type = genomic DNA

SEQ ID NO: 131685 - DNA, 35 bp, Homo sapiens; identical to SEQ ID NO: 101453
  misc_feature 1..35: note = chrX:23714117-23714152
  misc_feature 1..35: note = Hypo
  source 1..35: mol_type = genomic DNA

SEQ ID NO: 131686 - DNA, 22 bp, Homo sapiens
  misc_feature 1..22: note = chrX:23825274-23825296
  misc_feature 1..22: note = Hypo
  source 1..22: mol_type = genomic DNA
gcaagaccgtctcctcccaaaa

SEQ ID NO: 131687 - DNA, 30 bp, Homo sapiens; identical to SEQ ID NO: 101455
  misc_feature 1..30: note = chrX:24074681-24074711
  misc_feature 1..30: note = Hypo
  source 1..30: mol_type = genomic DNA

SEQ ID NO: 131688 - DNA, 100 bp, Homo sapiens; identical to SEQ ID NO: 101456
  misc_feature 1..100: note = chrX:25039052-25039152
  misc_feature 1..100: note = Hyper
  source 1..100: mol_type = genomic DNA

SEQ ID NO: 131689 - DNA, 173 bp, Homo sapiens; identical to SEQ ID NO: 101457
  misc_feature 1..173: note = chrX:26179543-26179716
  misc_feature 1..173: note = Hypo
  source 1..173: mol_type = genomic DNA

SEQ ID NO: 131690 - DNA, 30 bp, Homo sapiens; identical to SEQ ID NO: 101469
  misc_feature 1..30: note = chrX:29374805-29374835
  misc_feature 1..30: note = Hypo
  source 1..30: mol_type = genomic DNA

SEQ ID NO: 131691 - DNA, 30 bp, Homo sapiens; identical to SEQ ID NO: 101471
  misc_feature 1..30: note = chrX:30648695-30648725
  misc_feature 1..30: note = Hypo
  source 1..30: mol_type = genomic DNA

SEQ ID NO: 131692 - DNA, 122 bp, Homo sapiens; identical to SEQ ID NO: 101477
  misc_feature 1..122: note = chrX:33744448-33744570
  misc_feature 1..122: note = Hyper
  source 1..122: mol_type = genomic DNA

SEQ ID NO: 131693 - DNA, 94 bp, Homo sapiens; identical to SEQ ID NO: 101478
  misc_feature 1..94: note = chrX:34149739-34149833
  misc_feature 1..94: note = Hypo
  source 1..94: mol_type = genomic DNA

SEQ ID NO: 131694 - DNA, 30 bp, Homo sapiens; identical to SEQ ID NO: 101483
  misc_feature 1..30: note = chrX:39868222-39868252
  misc_feature 1..30: note = Hyper
  source 1..30: mol_type = genomic DNA

SEQ ID NO: 131695 - DNA, 30 bp, Homo sapiens; identical to SEQ ID NO: 101484
  misc_feature 1..30: note = chrX:39964600-39964630
  misc_feature 1..30: note = Hyper
  source 1..30: mol_type = genomic DNA

SEQ ID NO: 131696 - DNA, 30 bp, Homo sapiens; identical to SEQ ID NO: 101485
  misc_feature 1..30: note = chrX:39968920-39968950
  misc_feature 1..30: note = Hyper
  source 1..30: mol_type = genomic DNA

SEQ ID NO: 131697 - DNA, 323 bp, Homo sapiens; identical to SEQ ID NO: 101486
  misc_feature 1..323: note = chrX:40005519-40005842
  misc_feature 1..323: note = Hyper
  source 1..323: mol_type = genomic DNA

SEQ ID NO: 131698 - DNA, 30 bp, Homo sapiens; identical to SEQ ID NO: 101487
  misc_feature 1..30: note = chrX:40006116-40006146
  misc_feature 1..30: note = Hyper
  source 1..30: mol_type = genomic DNA

SEQ ID NO: 131699 - DNA, 132 bp, Homo sapiens; identical to SEQ ID NO: 101488
  misc_feature 1..132: note = chrX:40014537-40014669
  misc_feature 1..132: note = Hyper
  source 1..132: mol_type = genomic DNA

SEQ ID NO: 131700 - DNA, 377 bp, Homo sapiens; identical to SEQ ID NO: 101489
  misc_feature 1..377: note = chrX:40017591-40017968
  misc_feature 1..377: note = Hyper
  source 1..377: mol_type = genomic DNA

SEQ ID NO: 131701 - DNA, 44 bp, Homo sapiens
  misc_feature 1..44: note = chrX:40031129-40031173
  misc_feature 1..44: note = Hyper
  source 1..44: mol_type = genomic DNA
tgttctgccttaaggcgcgcgggctgatgcgctctctccctcgg

SEQ ID NO: 131702 - DNA, 44 bp, Homo sapiens; identical to SEQ ID NO: 38658
  misc_feature 1..44: note = chrX:40031390-40031434
  misc_feature 1..44: note = Hyper
  source 1..44: mol_type = genomic DNA

SEQ ID NO: 131703 - DNA, 632 bp, Homo sapiens; identical to SEQ ID NO: 101491
  misc_feature 1..632: note = chrX:40034425-40035057
  misc_feature 1..632: note = Hyper
  source 1..632: mol_type = genomic DNA

SEQ ID NO: 131704 - DNA, 30 bp, Homo sapiens
  misc_feature 1..30: note = chrX:40035724-40035754
  misc_feature 1..30: note = Hyper
  source 1..30: mol_type = genomic DNA
agaaaacaaggccggcgactacaagagcgg

SEQ ID NO: 131705 - DNA, 124 bp, Homo sapiens; identical to SEQ ID NO: 101493
  misc_feature 1..124: note = chrX:40126463-40126587
  misc_feature 1..124: note = Hyper
  source 1..124: mol_type = genomic DNA

SEQ ID NO: 131706 - DNA, 54 bp, Homo sapiens; identical to SEQ ID NO: 46889
  misc_feature 1..54: note = chrX:41331697-41331751
  misc_feature 1..54: note = Hypo
  source 1..54: mol_type = genomic DNA

SEQ ID NO: 131707 - DNA, 22 bp, Homo sapiens
  misc_feature 1..22: note = chrX:44136212-44136234
  misc_feature 1..22: note = Hypo
  source 1..22: mol_type = genomic DNA
acttacagctgaggccgggcac

SEQ ID NO: 131708 - DNA, 100 bp, Homo sapiens; identical to SEQ ID NO: 101497
  misc_feature 1..100: note = chrX:44202862-44202962
  misc_feature 1..100: note = Hyper
  source 1..100: mol_type = genomic DNA

SEQ ID NO: 131709 - DNA, 163 bp, Homo sapiens; identical to SEQ ID NO: 101498
  misc_feature 1..163: note = chrX:44729844-44730007
  misc_feature 1..163: note = Hypo
  source 1..163: mol_type = genomic DNA

SEQ ID NO: 131710 - DNA, 36 bp, Homo sapiens; identical to SEQ ID NO: 101499
  misc_feature 1..36: note = chrX:44751504-44751540
  misc_feature 1..36: note = Hypo
  source 1..36: mol_type = genomic DNA

SEQ ID NO: 131711 - DNA, 22 bp, Homo sapiens
  misc_feature 1..22: note = chrX:44755610-44755632
  misc_feature 1..22: note = Hypo
  source 1..22: mol_type = genomic DNA
ccgcgcccggccaaaaataaat

SEQ ID NO: 131712 - DNA, 52 bp, Homo sapiens; identical to SEQ ID NO: 46892
  misc_feature 1..52: note = chrX:44922962-44923014
  misc_feature 1..52: note = Hypo
  source 1..52: mol_type = genomic DNA

SEQ ID NO: 131713 - DNA, 99 bp, Homo sapiens; identical to SEQ ID NO: 101506
  misc_feature 1..99: note = chrX:47440990-47441089
  misc_feature 1..99: note = Hypo
  source 1..99: mol_type = genomic DNA

SEQ ID NO: 131714 - DNA, 30 bp, Homo sapiens; identical to SEQ ID NO: 101507
  misc_feature 1..30: note = chrX:54977452-54977482
  misc_feature 1..30: note = Hypo
  source 1..30: mol_type = genomic DNA

SEQ ID NO: 131715 - DNA, 40 bp, Homo sapiens; identical to SEQ ID NO: 46893
  misc_feature 1..40: note = chrX:58297213-58297253
  misc_feature 1..40: note = Hypo
  source 1..40: mol_type = genomic DNA

SEQ ID NO: 131716 - DNA, 30 bp, Homo sapiens; identical to SEQ ID NO: 46894
  misc_feature 1..30: note = chrX:58304829-58304859
  misc_feature 1..30: note = Hypo
  source 1..30: mol_type = genomic DNA

SEQ ID NO: 131717 - DNA, 124 bp, Homo sapiens; identical to SEQ ID NO: 101511
  misc_feature 1..124: note = chrX:58307150-58307274
  misc_feature 1..124: note = Hypo
  source 1..124: mol_type = genomic DNA

SEQ ID NO: 131718 - DNA, 30 bp, Homo sapiens; identical to SEQ ID NO: 101516
  misc_feature 1..30: note = chrX:67871660-67871690
  misc_feature 1..30: note = Hypo
  source 1..30: mol_type = genomic DNA

SEQ ID NO: 131719 - DNA, 145 bp, Homo sapiens; identical to SEQ ID NO: 101517
  misc_feature 1..145: note = chrX:69501680-69501825
  misc_feature 1..145: note = Hypo
  source 1..145: mol_type = genomic DNA

SEQ ID NO: 131720 - DNA, 155 bp, Homo sapiens; identical to SEQ ID NO: 101518
  misc_feature 1..155: note = chrX:71525843-71525998
  misc_feature 1..155: note = Hyper
  source 1..155: mol_type = genomic DNA

SEQ ID NO: 131721 - DNA, 34 bp, Homo sapiens; identical to SEQ ID NO: 101519
  misc_feature 1..34: note = chrX:71526883-71526917
  misc_feature 1..34: note = Hyper
  source 1..34: mol_type = genomic DNA

SEQ ID NO: 131722 - DNA, 30 bp, Homo sapiens; identical to SEQ ID NO: 101520
  misc_feature 1..30: note = chrX:73740816-73740846
  misc_feature 1..30: note = Hypo
  source 1..30: mol_type = genomic DNA

SEQ ID NO: 131723 - DNA, 38 bp, Homo sapiens; identical to SEQ ID NO: 101521
  misc_feature 1..38: note = chrX:78711045-78711083
  misc_feature 1..38: note = Hypo
  source 1..38: mol_type = genomic DNA

SEQ ID NO: 131724 - DNA, 30 bp, Homo sapiens; identical to SEQ ID NO: 101527
  misc_feature 1..30: note = chrX:91035211-91035241
  misc_feature 1..30: note = Hyper
  source 1..30: mol_type = genomic DNA

SEQ ID NO: 131725 - DNA, 516 bp, Homo sapiens; identical to SEQ ID NO: 101528
  misc_feature 1..516: note = chrX:91035598-91036114
  misc_feature 1..516: note = Hyper
  source 1..516: mol_type = genomic DNA

SEQ ID NO: 131726 - DNA, 221 bp, Homo sapiens; identical to SEQ ID NO: 101529
  misc_feature 1..221: note = chrX:91037061-91037282
  misc_feature 1..221: note = Hyper
  source 1..221: mol_type = genomic DNA

SEQ ID NO: 131727 - DNA, 41 bp, Homo sapiens; identical to SEQ ID NO: 101530
  misc_feature 1..41: note = chrX:92928695-92928736
  misc_feature 1..41: note = Hyper
  source 1..41: mol_type = genomic DNA

SEQ ID NO: 131728 - DNA, 105 bp, Homo sapiens; identical to SEQ ID NO: 101533
  misc_feature 1..105: note = chrX:97101386-97101491
  misc_feature 1..105: note = Hypo
  source 1..105: mol_type = genomic DNA

SEQ ID NO: 131729 - DNA, 101 bp, Homo sapiens; identical to SEQ ID NO: 101534
  misc_feature 1..101: note = chrX:97285055-97285156
  misc_feature 1..101: note = Hypo
  source 1..101: mol_type = genomic DNA

SEQ ID NO: 131730 - DNA, 30 bp, Homo sapiens; identical to SEQ ID NO: 101535
  misc_feature 1..30: note = chrX:99924339-99924369
  misc_feature 1..30: note = Hypo
  source 1..30: mol_type = genomic DNA

SEQ ID NO: 131731 - DNA, 46 bp, Homo sapiens; identical to SEQ ID NO: 101424
  misc_feature 1..46: note = chrX:103087251-103087297
  misc_feature 1..46: note = Hyper
  source 1..46: mol_type = genomic DNA

SEQ ID NO: 131732 - DNA, 199 bp, Homo sapiens; identical to SEQ ID NO: 101425
  misc_feature 1..199: note = chrX:108803671-108803870
  misc_feature 1..199: note = Hypo
  source 1..199: mol_type = genomic DNA

SEQ ID NO: 131733 - DNA, 164 bp, Homo sapiens; identical to SEQ ID NO: 101428
  misc_feature 1..164: note = chrX:122924437-122924601
  misc_feature 1..164: note = Hypo
  source 1..164: mol_type = genomic DNA

SEQ ID NO: 131734 - DNA, 80 bp, Homo sapiens; identical to SEQ ID NO: 101430
  misc_feature 1..80: note = chrX:136134699-136134779
  misc_feature 1..80: note = Hyper
  source 1..80: mol_type = genomic DNA

SEQ ID NO: 131735 - DNA, 34 bp, Homo sapiens
  misc_feature 1..34: note = chrX:136656397-136656431
  misc_feature 1..34: note = Hyper
  source 1..34: mol_type = genomic DNA
cccggggctcatcagcgaacgtcctctctcgctc

SEQ ID NO: 131736 - DNA, 94 bp, Homo sapiens; identical to SEQ ID NO: 101434
  misc_feature 1..94: note = chrX:139804733-139804827
  misc_feature 1..94: note = Hypo
  source 1..94: mol_type = genomic DNA

SEQ ID NO: 131737 - DNA, 30 bp, Homo sapiens; identical to SEQ ID NO: 101436
  misc_feature 1..30: note = chrX:150560243-150560273
  misc_feature 1..30: note = Hypo
  source 1..30: mol_type = genomic DNA

SEQ ID NO: 131738 - DNA, 30 bp, Homo sapiens; identical to SEQ ID NO: 101437
  misc_feature 1..30: note = chrX:150732700-150732730
  misc_feature 1..30: note = Hypo
  source 1..30: mol_type = genomic DNA

SEQ ID NO: 131739 - DNA, 30 bp, Homo sapiens; identical to SEQ ID NO: 101438
  misc_feature 1..30: note = chrX:151080838-151080868
  misc_feature 1..30: note = Hypo
  source 1..30: mol_type = genomic DNA

SEQ ID NO: 131740 - DNA, 30 bp, Homo sapiens; identical to SEQ ID NO: 101439
  misc_feature 1..30: note = chrX:151088584-151088614
  misc_feature 1..30: note = Hypo
  source 1..30: mol_type = genomic DNA

SEQ ID NO: 131741 - DNA, 67 bp, Homo sapiens; identical to SEQ ID NO: 101545
  misc_feature 1..67: note = chrY:4869647-4869714
  misc_feature 1..67: note = Hyper
  source 1..67: mol_type = genomic DNA

SEQ ID NO: 131742 - DNA, 210 bp, Homo sapiens; identical to SEQ ID NO: 101546
  misc_feature 1..210: note = chrY:6778824-6779034
  misc_feature 1..210: note = Hyper
  source 1..210: mol_type = genomic DNA

SEQ ID NO: 131743 - DNA, 30 bp, Homo sapiens; identical to SEQ ID NO: 101547
  misc_feature 1..30: note = chrY:6779293-6779323
  misc_feature 1..30: note = Hyper
  source 1..30: mol_type = genomic DNA

SEQ ID NO: 131744 - DNA, 61 bp, Homo sapiens; identical to SEQ ID NO: 101548
  misc_feature 1..61: note = chrY:6779746-6779807
  misc_feature 1..61: note = Hyper
  source 1..61: mol_type = genomic DNA

SEQ ID NO: 131745 - DNA, 20 bp, Homo sapiens
  misc_feature 1..20: note = chrY:14301600-14301620
  misc_feature 1..20: note = Hypo
  source 1..20: mol_type = genomic DNA
gagcgacacagaagacgggt

SEQ ID NO: 131746 - DNA, 57 bp, Homo sapiens; identical to SEQ ID NO: 101537
  misc_feature 1..57: note = chrY:14567906-14567963
  misc_feature 1..57: note = Hypo
  source 1..57: mol_type = genomic DNA

SEQ ID NO: 131747 - DNA, 30 bp, Homo sapiens; identical to SEQ ID NO: 46899
  misc_feature 1..30: note = chrY:14621298-14621328
  misc_feature 1..30: note = Hypo
  source 1..30: mol_type = genomic DNA

SEQ ID NO: 131748 - DNA, 243 bp, Homo sapiens; identical to SEQ ID NO: 101539
  misc_feature 1..243: note = chrY:16635817-16636060
  misc_feature 1..243: note = Hyper
  source 1..243: mol_type = genomic DNA

SEQ ID NO: 131749 - DNA, 89 bp, Homo sapiens; identical to SEQ ID NO: 101540
  misc_feature 1..89: note = chrY:21728053-21728142
  misc_feature 1..89: note = Hypo
  source 1..89: mol_type = genomic DNA

SEQ ID NO: 131750 - DNA, 116 bp, Homo sapiens; identical to SEQ ID NO: 101541
  misc_feature 1..116: note = chrY:22901316-22901432
  misc_feature 1..116: note = Hypo
  source 1..116: mol_type = genomic DNA

SEQ ID NO: 131751 - DNA, 159 bp, Homo sapiens; identical to SEQ ID NO: 101542
  misc_feature 1..159: note = chrY:22918423-22918582
  misc_feature 1..159: note = Hypo
  source 1..159: mol_type = genomic DNA

SEQ ID NO: 131752 - DNA, 94 bp, Homo sapiens; identical to SEQ ID NO: 101543
  misc_feature 1..94: note = chrY:23111711-23111805
  misc_feature 1..94: note = Hypo
  source 1..94: mol_type = genomic DNA

SEQ ID NO: 131753 - DNA, 30 bp, Homo sapiens; identical to SEQ ID NO: 101544
  misc_feature 1..30: note = chrY:23613703-23613733
  misc_feature 1..30: note = Hypo
  source 1..30: mol_type = genomic DNA

SEQ ID NO: 131754 - DNA, 40 bp, Homo sapiens; identical to SEQ ID NO: 101549
  misc_feature 1..40: note = CR856017.2_11887-39781:16677-16717
  misc_feature 1..40: note = Hypo
  source 1..40: mol_type = genomic DNA

SEQ ID NO: 131755 - DNA, 32 bp, Homo sapiens; identical to SEQ ID NO: 101550
  misc_feature 1..32: note = CR936360.14_69981-85448:11336-11368
  misc_feature 1..32: note = Hypo
  source 1..32: mol_type = genomic DNA

SEQ ID NO: 131756 - DNA, 30 bp, Homo sapiens; identical to SEQ ID NO: 46912
  misc_feature 1..30: note = FP565324.3_2001-29640:15187-15217
  misc_feature 1..30: note = Hypo
  source 1..30: mol_type = genomic DNA

SEQ ID NO: 131757 - DNA, 30 bp, Homo sapiens; identical to SEQ ID NO: 101552
  misc_feature 1..30: note = FP565324.3_2001-29640:19444-19474
  misc_feature 1..30: note = Hypo
  source 1..30: mol_type = genomic DNA

SEQ ID NO: 131758 - DNA, 124 bp, Homo sapiens; identical to SEQ ID NO: 101553
  misc_feature 1..124: note = FP565324.3_2001-29640:19686-19810
  misc_feature 1..124: note = Hypo
  source 1..124: mol_type = genomic DNA

SEQ ID NO: 131759 - DNA, 30 bp, Homo sapiens; identical to SEQ ID NO: 101554
  misc_feature 1..30: note = FP565324.3_2001-29640:25504-25534
  misc_feature 1..30: note = Hypo
  source 1..30: mol_type = genomic DNA

SEQ ID NO: 131760 - DNA, 264 bp, Homo sapiens; identical to SEQ ID NO: 101555
  misc_feature 1..264: note = GL000220.1:138909-139173
  misc_feature 1..264: note = Hypo
  source 1..264: mol_type = genomic DNA

SEQ ID NO: 131761 - DNA, 160 bp, Homo sapiens; identical to SEQ ID NO: 101556
  misc_feature 1..160: note = GL000258.1:893139-893299
  misc_feature 1..160: note = Hyper
  source 1..160: mol_type = genomic DNA

SEQ ID NO: 131762 - DNA, 30 bp, Homo sapiens; identical to SEQ ID NO: 101557
  misc_feature 1..30: note = GL383548.1:10245-10275
  misc_feature 1..30: note = Hypo
  source 1..30: mol_type = genomic DNA

SEQ ID NO: 131763 - DNA, 82 bp, Homo sapiens; identical to SEQ ID NO: 14151
  misc_feature 1..82: note = JH159140.1:144237-144319
  misc_feature 1..82: note = Hyper
  source 1..82: mol_type = genomic DNA

SEQ ID NO: 131764 - DNA, 184 bp, Homo sapiens; identical to SEQ ID NO: 101559
  misc_feature 1..184: note = JH636052.4:1361645-1361829
  misc_feature 1..184: note = Hyper
  source 1..184: mol_type = genomic DNA

SEQ ID NO: 131765 - DNA, 24 bp, Homo sapiens
  misc_feature 1..24: note = JH636052.4:1362108-1362132
  misc_feature 1..24: note = Hyper
  source 1..24: mol_type = genomic DNA
gacttgctcctacagcgcgggaaa

SEQ ID NO: 131766 - DNA, 24 bp, Homo sapiens
  misc_feature 1..24: note = JH636052.4:1362192-1362216
  misc_feature 1..24: note = Hyper
  source 1..24: mol_type = genomic DNA
tgatgtcaccgacagtgcctttcc

SEQ ID NO: 131767 - DNA, 30 bp, Homo sapiens; identical to SEQ ID NO: 101562
  misc_feature 1..30: note = JH636052.4:1370528-1370558
  misc_feature 1..30: note = Hypo
  source 1..30: mol_type = genomic DNA

SEQ ID NO: 131768 - DNA, 18 bp, Homo sapiens
  misc_feature 1..18: note = JH636052.4:2022610-2022628
  misc_feature 1..18: note = Hypo
  source 1..18: mol_type = genomic DNA
aacaataaaacaggccgg

SEQ ID NO: 131769 - DNA, 29 bp, Homo sapiens
  misc_feature 1..29: note = JH636052.4:2254977-2255006
  misc_feature 1..29: note = Hypo
  source 1..29: mol_type = genomic DNA
ccaccgcgcccggccggtttaccattttt

SEQ ID NO: 131770 - DNA, 32 bp, Homo sapiens; identical to SEQ ID NO: 101565
  misc_feature 1..32: note = JH636052.4:2269647-2269679
  misc_feature 1..32: note = Hyper
  source 1..32: mol_type = genomic DNA

SEQ ID NO: 131771 - DNA, 36 bp, Homo sapiens; identical to SEQ ID NO: 101566
  misc_feature 1..36: note = JH636052.4:2280989-2281025
  misc_feature 1..36: note = Hyper
  source 1..36: mol_type = genomic DNA

SEQ ID NO: 131772 - DNA, 89 bp, Homo sapiens; identical to SEQ ID NO: 101567
  misc_feature 1..89: note = JH636052.4:2302679-2302768
  misc_feature 1..89: note = Hyper
  source 1..89: mol_type = genomic DNA

SEQ ID NO: 131773 - DNA, 211 bp, Homo sapiens; identical to SEQ ID NO: 38684
  misc_feature 1..211: note = JH636052.4:5118718-5118929
  misc_feature 1..211: note = Hyper
  source 1..211: mol_type = genomic DNA

SEQ ID NO: 131774 - DNA, 225 bp, Homo sapiens; identical to SEQ ID NO: 101569
  misc_feature 1..225: note = JH636058.1:413166-413391
  misc_feature 1..225: note = Hyper
  source 1..225: mol_type = genomic DNA

SEQ ID NO: 131775 - DNA, 30 bp, Homo sapiens; identical to SEQ ID NO: 101573
  misc_feature 1..30: note = NW_001838014.1_249000-295694:441-471
  misc_feature 1..30: note = Hypo
  source 1..30: mol_type = genomic DNA

SEQ ID NO: 131776 - DNA, 61 bp, Homo sapiens; identical to SEQ ID NO: 46915
  misc_feature 1..61: note = NW_001838014.1_249000-295694:3702-3763
  misc_feature 1..61: note = Hypo
  source 1..61: mol_type = genomic DNA

SEQ ID NO: 131777 - DNA, 191 bp, Homo sapiens; identical to SEQ ID NO: 101572
  misc_feature 1..191: note = NW_001838014.1_249000-295694:4069-4260
  misc_feature 1..191: note = Hypo
  source 1..191: mol_type = genomic DNA

SEQ ID NO: 131778 - DNA, 284 bp, Homo sapiens; identical to SEQ ID NO: 101574
  misc_feature 1..284: note = NW_001838014.1_249000-295694:7106-7390
  misc_feature 1..284: note = Hypo
  source 1..284: mol_type = genomic DNA

SEQ ID NO: 131779 - DNA, 445 bp, Homo sapiens; identical to SEQ ID NO: 101570
  misc_feature 1..445: note = NW_001838014.1_249000-295694:13512-13957
  misc_feature 1..445: note = Hypo
  source 1..445: mol_type = genomic DNA

SEQ ID NO: 131780 - DNA, 36 bp, Homo sapiens; identical to SEQ ID NO: 101575
  misc_feature 1..36: note = NW_001838016.1_818233-828058:5545-5581
  misc_feature 1..36: note = Hypo
  source 1..36: mol_type = genomic DNA

SEQ ID NO: 131781 - DNA, 30 bp, Homo sapiens; identical to SEQ ID NO: 101576
  misc_feature 1..30: note = NW_001838016.1_818233-828058:6037-6067
  misc_feature 1..30: note = Hypo
  source 1..30: mol_type = genomic DNA

SEQ ID NO: 131782 - DNA, 30 bp, Homo sapiens; identical to SEQ ID NO: 101577
  misc_feature 1..30: note = NW_001838016.1_818233-828058:6848-6878
  misc_feature 1..30: note = Hypo
  source 1..30: mol_type = genomic DNA

SEQ ID NO: 131783 - DNA, 32 bp, Homo sapiens; identical to SEQ ID NO: 101578
  misc_feature 1..32: note = NW_001838016.1_818233-828058:7308-7340
  misc_feature 1..32: note = Hypo
  source 1..32: mol_type = genomic DNA

SEQ ID NO: 131784 - DNA, 166 bp, Homo sapiens; identical to SEQ ID NO: 101579
  misc_feature 1..166: note = NW_001838016.1_818233-828058:7554-7720
  misc_feature 1..166: note = Hypo
  source 1..166: mol_type = genomic DNA

SEQ ID NO: 131785 - DNA, 81 bp, Homo sapiens; identical to SEQ ID NO: 101580
  misc_feature 1..81: note = NW_001838056.1_145425-224902:38739-38820
  misc_feature 1..81: note = Hypo
  source 1..81: mol_type = genomic DNA

SEQ ID NO: 131786 - DNA, 140 bp, Homo sapiens; identical to SEQ ID NO: 101581
  misc_feature 1..140: note = NW_001838056.1_145425-224902:42669-42809
  misc_feature 1..140: note = Hypo
  source 1..140: mol_type = genomic DNA

SEQ ID NO: 131787 - DNA, 30 bp, Homo sapiens; identical to SEQ ID NO: 101582
  misc_feature 1..30: note = NW_001838194.1_126783-128006:853-883
  misc_feature 1..30: note = Hypo
  source 1..30: mol_type = genomic DNA

SEQ ID NO: 131788 - DNA, 274 bp, Homo sapiens; identical to SEQ ID NO: 101583
  misc_feature 1..274: note = NW_001838403.1_1-2251:78-352
  misc_feature 1..274: note = Hyper
  source 1..274: mol_type = genomic DNA

SEQ ID NO: 131789 - DNA, 70 bp, Homo sapiens; identical to SEQ ID NO: 101584
  misc_feature 1..70: note = NW_001838877.2_33615069-33616110:636-706
  misc_feature 1..70: note = Hypo
  source 1..70: mol_type = genomic DNA

SEQ ID NO: 131790 - DNA, 24 bp, Homo sapiens
  misc_feature 1..24: note = NW_001839407.1_42766-49957:1190-1214
  misc_feature 1..24: note = Hypo
  source 1..24: mol_type = genomic DNA
tcgccggcccgctggtgcctctgc

SEQ ID NO: 131791 - DNA, 30 bp, Homo sapiens; identical to SEQ ID NO: 101587
  misc_feature 1..30: note = NW_001839407.1_56047-63507:754-784
  misc_feature 1..30: note = Hypo
  source 1..30: mol_type = genomic DNA

SEQ ID NO: 131792 - DNA, 39 bp, Homo sapiens; identical to SEQ ID NO: 101586
  misc_feature 1..39: note = NW_001839407.1_56047-63507:7039-7078
  misc_feature 1..39: note = Hypo
  source 1..39: mol_type = genomic DNA

SEQ ID NO: 131793 - DNA, 77 bp, Homo sapiens; identical to SEQ ID NO: 101588
  misc_feature 1..77: note = NW_001839455.1_124947-137693:9386-9463
  misc_feature 1..77: note = Hypo
  source 1..77: mol_type = genomic DNA

SEQ ID NO: 131794 - DNA, 140 bp, Homo sapiens; identical to SEQ ID NO: 101589
  misc_feature 1..140: note = NW_001839455.1_50266-109797:44348-44488
  misc_feature 1..140: note = Hypo
  source 1..140: mol_type = genomic DNA

SEQ ID NO: 131795 - DNA, 30 bp, Homo sapiens; identical to SEQ ID NO: 101590
  misc_feature 1..30: note = NW_001839603.1_36678-41438:2681-2711
  misc_feature 1..30: note = Hypo
  source 1..30: mol_type = genomic DNA

SEQ ID NO: 131796 - DNA, 39 bp, Homo sapiens; identical to SEQ ID NO: 101591
  misc_feature 1..39: note = NW_001839609.1_1-3470:1119-1158
  misc_feature 1..39: note = Hypo
  source 1..39: mol_type = genomic DNA

SEQ ID NO: 131797 - DNA, 75 bp, Homo sapiens; identical to SEQ ID NO: 101592
  misc_feature 1..75: note = NW_001839668.1_21493-58548:15519-15594
  misc_feature 1..75: note = Hypo
  source 1..75: mol_type = genomic DNA

SEQ ID NO: 131798 - DNA, 90 bp, Homo sapiens; identical to SEQ ID NO: 46922
  misc_feature 1..90: note = NW_001839760.1_243903-260476:6752-6842
  misc_feature 1..90: note = Hypo
  source 1..90: mol_type = genomic DNA

SEQ ID NO: 131799 - DNA, 64 bp, Homo sapiens; identical to SEQ ID NO: 101594
  misc_feature 1..64: note = NW_001840246.1_7363-10559:45-109
  misc_feature 1..64: note = Hypo
  source 1..64: mol_type = genomic DNA

SEQ ID NO: 131800 - DNA, 32 bp, Homo sapiens; identical to SEQ ID NO: 101595
  misc_feature 1..32: note = NW_001840306.1_6328-82586:11021-11053
  misc_feature 1..32: note = Hypo
  source 1..32: mol_type = genomic DNA

SEQ ID NO: 131801 - DNA, 178 bp, Homo sapiens; identical to SEQ ID NO: 101596
  misc_feature 1..178: note = NW_001840306.1_6328-82586:33514-33692
  misc_feature 1..178: note = Hypo
  source 1..178: mol_type = genomic DNA

SEQ ID NO: 131802 - DNA, 29 bp, Homo sapiens
  misc_feature 1..29: note = NW_001840646.1_6803-11069:2056-2085
  misc_feature 1..29: note = Hypo
  source 1..29: mol_type = genomic DNA
ccttccggaggagccgtggaggcataggc

SEQ ID NO: 131803 - DNA, 77 bp, Homo sapiens; identical to SEQ ID NO: 101598
  misc_feature 1..77: note = NW_001840700.1_1-4272:2301-2378
  misc_feature 1..77: note = Hypo
  source 1..77: mol_type = genomic DNA

SEQ ID NO: 131804 - DNA, 16 bp, Homo sapiens
  misc_feature 1..16: note = NW_001840754.1_117-3691:2521-2537
  misc_feature 1..16: note = Hypo
  source 1..16: mol_type = genomic DNA
ccgcagggagggtgcc

SEQ ID NO: 131805 - DNA, 30 bp, Homo sapiens; identical to SEQ ID NO: 46924
  misc_feature 1..30: note = NW_001840841.1_1-4205:1669-1699
  misc_feature 1..30: note = Hypo
  source 1..30: mol_type = genomic DNA

SEQ ID NO: 131806 - DNA, 187 bp, Homo sapiens; identical to SEQ ID NO: 101601
  misc_feature 1..187: note = NW_001840866.1_38854-140524:80412-80599
  misc_feature 1..187: note = Hypo
  source 1..187: mol_type = genomic DNA

SEQ ID NO: 131807 - DNA, 30 bp, Homo sapiens; identical to SEQ ID NO: 101602
  misc_feature 1..30: note = NW_001840954.1_1-14936:6819-6849
  misc_feature 1..30: note = Hypo
  source 1..30: mol_type = genomic DNA

SEQ ID NO: 131808 - DNA, 23 bp, Homo sapiens
  misc_feature 1..23: note = NW_001841011.1_96346-168555:36552-36575
  misc_feature 1..23: note = Hypo
  source 1..23: mol_type = genomic DNA
ggggggaacgagtgacctttcca

SEQ ID NO: 131809 - DNA, 36 bp, Homo sapiens; identical to SEQ ID NO: 101604
  misc_feature 1..36: note = NW_001841011.1_96346-168555:37241-37277
  misc_feature 1..36: note = Hypo
  source 1..36: mol_type = genomic DNA

SEQ ID NO: 131810 - DNA, 120 bp, Homo sapiens; identical to SEQ ID NO: 101605
  misc_feature 1..120: note = NW_001841051.1_40144-46142:4764-4884
  misc_feature 1..120: note = Hypo
  source 1..120: mol_type = genomic DNA

SEQ ID NO: 131811 - DNA, 78 bp, Homo sapiens; identical to SEQ ID NO: 101606
  misc_feature 1..78: note = NW_001841110.1_111-11841:9020-9098
  misc_feature 1..78: note = Hypo
  source 1..78: mol_type = genomic DNA

SEQ ID NO: 131812 - DNA, 37 bp, Homo sapiens; identical to SEQ ID NO: 101607
  misc_feature 1..37: note = NW_001841138.1_665891-688550:14581-14618
  misc_feature 1..37: note = Hypo
  source 1..37: mol_type = genomic DNA

SEQ ID NO: 131813 - DNA, 18 bp, Homo sapiens
  misc_feature 1..18: note = NW_001841138.1_67124-102688:26293-26311
  misc_feature 1..18: note = Hypo
  source 1..18: mol_type = genomic DNA
ggccgtgcaacaaacaaa

SEQ ID NO: 131814 - DNA, 137 bp, Homo sapiens; identical to SEQ ID NO: 101609
  misc_feature 1..137: note = NW_001841138.1_67124-102688:27763-27900
  misc_feature 1..137: note = Hypo
  source 1..137: mol_type = genomic DNA

SEQ ID NO: 131815 - DNA, 55 bp, Homo sapiens; identical to SEQ ID NO: 46928
  misc_feature 1..55: note = NW_001841145.1_177495-186900:5222-5277
  misc_feature 1..55: note = Hypo
  source 1..55: mol_type = genomic DNA

SEQ ID NO: 131816 - DNA, 37 bp, Homo sapiens; identical to SEQ ID NO: 101611
  misc_feature 1..37: note = NW_001841145.1_177495-186900:6312-6349
  misc_feature 1..37: note = Hypo
  source 1..37: mol_type = genomic DNA

SEQ ID NO: 131817 - DNA, 25 bp, Homo sapiens
  misc_feature 1..25: note = NW_001841145.1_68487-74424:228-253
  misc_feature 1..25: note = Hypo
  source 1..25: mol_type = genomic DNA
ctccacacagcggagaggtgccgtt

SEQ ID NO: 131818 - DNA, 39 bp, Homo sapiens; identical to SEQ ID NO: 101613
  misc_feature 1..39: note = NW_001841157.1_1611084-1612812:1051-1090
  misc_feature 1..39: note = Hypo
  source 1..39: mol_type = genomic DNA

SEQ ID NO: 131819 - DNA, 20 bp, Homo sapiens
  misc_feature 1..20: note = NW_001841160.1_117611-172877:34909-34929
  misc_feature 1..20: note = Hypo
  source 1..20: mol_type = genomic DNA
gtaatcgaatggaataaata

SEQ ID NO: 131820 - DNA, 69 bp, Homo sapiens; identical to SEQ ID NO: 46929
  misc_feature 1..69: note = NW_001842432.1_1-179261:101291-101360
  misc_feature 1..69: note = Hypo
  source 1..69: mol_type = genomic DNA

SEQ ID NO: 131821 - DNA, 95 bp, Homo sapiens; identical to SEQ ID NO: 101616
  misc_feature 1..95: note = NW_001842432.1_1-179261:103119-103214
  misc_feature 1..95: note = Hypo
  source 1..95: mol_type = genomic DNA

SEQ ID NO: 131822 - DNA, 157 bp, Homo sapiens; identical to SEQ ID NO: 101617
  misc_feature 1..157: note = NW_001842432.1_1-179261:113208-113365
  misc_feature 1..157: note = Hypo
  source 1..157: mol_type = genomic DNA
